United States Patent 11,596,686 (CORONAVIRUS VACCINE) - sequence listing, part 11

SEQ ID NO: 23072 - RNA, 3822 nt, synthetic construct
  misc_feature 1..3822: note = SARS-CoV-2/Wuhan/WIV05/2019__EPI_ISL_402128 spike protein CDS gc mod (1-1273)(K417N_E484K_N501Y_D614G)
  source 1..3822: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23073 - RNA, 3813 nt, synthetic construct
  misc_feature 1..3813: note = SARS-CoV-2/Wuhan/WIV05/2019__EPI_ISL_402128 spike protein CDS gc mod (1-1273)(L18F_D80A_D215G_L242del_A243del_L244del_R246I_K417 N_E484K_N501Y_D614G_A701V)
  source 1..3813: mol_type = other RNA
atgttcgtgttcctggtgctgctgcctctggtgtccagccagtgtgtgaacttcaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgtggagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23074 - RNA, 3822 nt, synthetic construct
  misc_feature 1..3822: note = SARS-CoV-2/Wuhan/WIV05/2019__EPI_ISL_402128 spike protein CDS gc mod (1-1273)(E484K_D614G)
  source 1..3822: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23075 - RNA, 3822 nt, synthetic construct
  misc_feature 1..3822: note = SARS-CoV-2/Wuhan/WIV05/2019__EPI_ISL_402128 spike protein CDS gc mod (1-1273)(L18F_T20N_P26S_D138Y_R190S_K417T_E484K_N501Y_D614G _H655Y_T1027I)
  source 1..3822: mol_type = other RNA
atgttcgtgttcctggtgctgctgcctctggtgtccagccagtgtgtgaacttcaccaacagaacacagctgcctagcgcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23076 - RNA, 3822 nt, synthetic construct
  misc_feature 1..3822: note = SARS-CoV-2/Wuhan/WIV05/2019__EPI_ISL_402128 spike protein CDS gc mod (1-1273)(S13I_W152C_L452R_D614G)
  source 1..3822: mol_type = other RNA
atgttcgtgttcctggtgctgctgcctctggtgtccatccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23077 - RNA, 3822 nt, synthetic construct; identical to SEQ ID NO: 137
  misc_feature 1..3822: note = SARS-CoV-2/Wuhan/WIV05/2019__EPI_ISL_402128 spike protein CDS gc (1-1273)(K986P_V987P)
  source 1..3822: mol_type = other RNA

SEQ ID NO: 23078 - RNA, 3822 nt, synthetic construct; identical to SEQ ID NO: 22765
  misc_feature 1..3822: note = SARS-CoV-2/Wuhan/WIV05/2019__EPI_ISL_402128 spike protein CDS gc (1-1273)(K986P_V987P_ D614G)
  source 1..3822: mol_type = other RNA

SEQ ID NO: 23079 - RNA, 3822 nt, synthetic construct; identical to SEQ ID NO: 22767
  misc_feature 1..3822: note = SARS-CoV-2/Wuhan/WIV05/2019__EPI_ISL_402128 spike protein CDS gc (1-1273)(K986P_V987P_A222V_D614G)
  source 1..3822: mol_type = other RNA

SEQ ID NO: 23080 - RNA, 3822 nt, synthetic construct; identical to SEQ ID NO: 22769
  misc_feature 1..3822: note = SARS-CoV-2/Wuhan/WIV05/2019__EPI_ISL_402128 spike protein CDS gc (1-1273)(K986P_V987P_N439K_D614G)
  source 1..3822: mol_type = other RNA

SEQ ID NO: 23081 - RNA, 3822 nt, synthetic construct; identical to SEQ ID NO: 22771
  misc_feature 1..3822: note = SARS-CoV-2/Wuhan/WIV05/2019__EPI_ISL_402128 spike protein CDS gc (1-1273)(K986P_V987P_S477N_D614G)
  source 1..3822: mol_type = other RNA

SEQ ID NO: 23082 - RNA, 3822 nt, synthetic construct; identical to SEQ ID NO: 22773
  misc_feature 1..3822: note = SARS-CoV-2/Wuhan/WIV05/2019__EPI_ISL_402128 spike protein CDS gc (1-1273)(K986P_V987P_N501Y_D614G)
  source 1..3822: mol_type = other RNA

SEQ ID NO: 23083 - RNA, 3816 nt, synthetic construct; identical to SEQ ID NO: 22775
  misc_feature 1..3816: note = SARS-CoV-2/Wuhan/WIV05/2019__EPI_ISL_402128 spike protein CDS gc (1-1273)(K986P_V987P_H69del_V70del_D614G)
  source 1..3816: mol_type = other RNA

SEQ ID NO: 23084 - RNA, 3822 nt, synthetic construct; identical to SEQ ID NO: 22777
  misc_feature 1..3822: note = SARS-CoV-2/Wuhan/WIV05/2019__EPI_ISL_402128 spike protein CDS gc (1-1273)(K986P_V987P_Y453F_D614G)
  source 1..3822: mol_type = other RNA

SEQ ID NO: 23085 - RNA, 3822 nt, synthetic construct; identical to SEQ ID NO: 22779
  misc_feature 1..3822: note = SARS-CoV-2/Wuhan/WIV05/2019__EPI_ISL_402128 spike protein CDS gc (1-1273)(K986P_V987P_D614G_I692V)
  source 1..3822: mol_type = other RNA

SEQ ID NO: 23086 - RNA, 3822 nt, synthetic construct; identical to SEQ ID NO: 22781
  misc_feature 1..3822: note = SARS-CoV-2/Wuhan/WIV05/2019__EPI_ISL_402128 spike protein CDS gc (1-1273)(K986P_V987P_D614G_M1229I)
  source 1..3822: mol_type = other RNA

SEQ ID NO: 23087 - RNA, 3816 nt, synthetic construct; identical to SEQ ID NO: 22783
  misc_feature 1..3816: note = SARS-CoV-2/Wuhan/WIV05/2019__EPI_ISL_402128 spike protein CDS gc (1-1273)(K986P_V987P_H69del_V70del_A222V_Y453F_S477N_D614G_ I692V)
  source 1..3816: mol_type = other RNA

SEQ ID NO: 23088 - RNA, 3816 nt, synthetic construct; identical to SEQ ID NO: 22785
  misc_feature 1..3816: note = SARS-CoV-2/Wuhan/WIV05/2019__EPI_ISL_402128 spike protein CDS gc (1-1273)(K986P_V987P_H69del_V70del_Y453F_D614G_I692V_M1229I )
  source 1..3816: mol_type = other RNA

SEQ ID NO: 23089 - RNA, 3813 nt, synthetic construct
  misc_feature 1..3813: note = SARS-CoV-2/Wuhan/WIV05/2019__EPI_ISL_402128 spike protein CDS gc (1-1273)(K986P_V987P_K986P_V987P_H69del_V70del_Y144del_N501 Y_A570D_D614G_P681H_T716I_S982A_D1118H)
  source 1..3813: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgacgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactcccaccggcgcgcccggagcgtggcgtcccagagcatcatcgcctacaccatgtccctgggcgccgagaacagcgtcgcctactccaacaacagcatcgccatccccatcaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctcgcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccacccacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 23090 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_K986P_V987P_K417N_E484K_N501Y_D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 23091 - RNA, 3813 nt, synthetic construct
  misc_feature 1..3813: note = SARS-CoV-2/Wuhan/WIV05/2019__EPI_ISL_402128 spike protein CDS gc (1-1273)(K986P_V987P_K986P_V987P_L18F_D80A_D215G_L242del_A2 43del_L244del_R246I_K417N_E484K_N501Y_D614G_A701V)
  source 1..3813: mol_type = other RNA
atgttcgtgttcctggtcctcctgcccctggtgagctcccagtgcgtgaacttcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgccaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccggggcctgccccaggggttcagcgccctcgagcccctggtggacctgcccatcggcatcaacatcacccgcttccagaccctccacatctcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgtggagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 23092 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_K986P_V987P_E484K_D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 23093 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_K986P_V987P_L18F_T20N_P26S_D138Y_R190S _K417T_E484K_N501Y_D614G_H655Y_T1027I)
  source 1..3822: mol_type = other RNA
atgttcgtgttcctggtcctcctgcccctggtgagctcccagtgcgtgaacttcaccaaccgcacgcagctgccgagcgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaactaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctcagcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaccatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgatcaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 23094 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_K986P_V987P_S13I_W152C_L452R_D614G)
  source 1..3822: mol_type = other RNA
atgttcgtgttcctggtcctcctgcccctggtgagcatccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctgcatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactaccgctaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 23095 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtccagatcgaccggctgatcaccgggcgcctccagagcctgcagacctacgtgacccagcagctgatccgggcggccgagatccgcgccagcgccaacctcgccgcgaccaagatgtccgagtgcgtgctgggccagagcaagcgggtcgacttctgcggcaaggggtaccacctgatgtccttcccccagagcgcgccccacggcgtggtgttcctccacgtcacgtacgtgcccgcccaggagaagaacttcaccaccgccccggccatctgccacgacgggaaggcccacttcccccgcgagggcgtcttcgtgtccaacgggacccactggttcgtgacgcagcggaacttctacgagccccagatcatcaccaccgacaacaccttcgtcagcggcaactgcgacgtggtgatcggcatcgtcaacaacacggtgtacgaccccctgcagccggagctggactccttcaaggaggagctcgacaagtacttcaagaaccacaccagccccgacgtggacctgggggacatctccggcatcaacgccagcgtcgtgaacatccagaaggagatcgaccgcctgaacgaggtggccaagaacctcaacgagtccctgatcgacctgcaggagctcgggaagtacgagcagtacatcaagtggccctggtacatctggctgggcttcatcgccggcctgatcgcgatcgtcatggtgaccatcatgctctgctgcatgaccagctgctgctcctgcctgaaggggtgctgcagctgcggctcctgctgcaagttcgacgaggacgacagcgagccggtgctgaagggggtcaagctccactacacgtga

SEQ ID NO: 23096 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_ D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtga

SEQ ID NO: 23097 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_A222V_D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtgctcgagcccctggtggacctgcccatcggcatcaacatcacccgcttccagaccctcctggccctgcaccggtcctacctcacgccgggggacagcagctccggctggaccgccggcgcggccgcctactacgtcgggtacctgcagccccgcaccttcctgctcaagtacaacgagaacggcaccatcacggacgccgtggactgcgcgctggaccccctgagcgagaccaagtgcaccctcaagtccttcaccgtggagaaggggatctaccagacgagcaacttccgggtccagcccaccgagtccatcgtgcgcttcccgaacatcaccaacctgtgccccttcggcgaggtcttcaacgccacccggttcgccagcgtgtacgcctggaaccgcaagcggatctccaactgcgtggccgactacagcgtcctgtacaactccgcgagcttctccacgttcaagtgctacggcgtgagccccaccaagctcaacgacctgtgcttcaccaacgtgtacgccgactccttcgtcatccgcggggacgaggtgcggcagatcgcccccggccagaccgggaagatcgccgactacaactacaagctgccggacgacttcacgggctgcgtgatcgcctggaacagcaacaacctcgactccaaggtcgggggcaactacaactacctgtaccgcctgttccgcaagagcaacctcaagcccttcgagcgggacatctccaccgagatctaccaggcgggcagcaccccctgcaacggggtggagggcttcaactgctacttccccctgcagtcctacgggttccagccgaccaacggcgtggggtaccagccctaccgggtcgtggtgctgagcttcgagctcctgcacgcccccgccacggtctgcggccccaagaagtccaccaacctggtgaagaacaagtgcgtgaacttcaacttcaacggcctcaccgggaccggcgtcctgaccgagagcaacaagaagttcctgccgttccagcagttcgggcgcgacatcgccgacacgaccgacgccgtgcgcgacccccagaccctggagatcctcgacatcaccccctgcagcttcggcggggtgtccgtcatcacgccgggcaccaacaccagcaaccaggtggcggtgctgtaccagggcgtcaactgcaccgaggtgcccgtggccatccacgccgaccagctgacgcccacctggcgggtctactccaccgggagcaacgtgttccagacccgcgccggctgcctcatcggggccgagcacgtgaacaactcctacgagtgcgacatccccatcggcgcgggcatctgcgccagctaccagacgcagaccaactccccgcggcgcgcccggagcgtcgcctcccagagcatcatcgcgtacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgccctgacgggcatcgcggtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacccgcccgaggccgaggtgcagatcgaccggctgatcaccggccgcctccagagcctgcagacctacgtgacccagcagctgatccgggccgcggagatccgcgccagcgccaacctcgccgccaccaagatgtccgagtgcgtcctgggccagagcaagcgggtggacttctgcgggaagggctaccacctgatgtccttcccccagagcgcgccccacggggtggtcttcctccacgtgacgtacgtccccgcccaggagaagaacttcaccaccgccccggccatctgccacgacggcaaggcgcacttcccccgcgagggggtgttcgtgtccaacggcacccactggttcgtcacgcagcggaacttctacgagccccagatcatcaccaccgacaacaccttcgtgagcggcaactgcgacgtggtcatcgggatcgtgaacaacacggtgtacgaccccctgcagccggagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccctggtacatctggctgggcttcatcgccgggctgatcgccatcgtgatggtgaccatcatgctctgctgcatgaccagctgctgctcctgcctgaagggctgctgcagctgcgggtcctgctgcaagttcgacgaggacgacagcgagccggtcctgaagggcgtgaagctccactacacgtga

SEQ ID NO: 23098 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_N439K_D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtga

SEQ ID NO: 23099 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_S477N_D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgagcgtgatcacgccgggcaccaacacctccaaccaggtcgccgtgctgtaccagggcgtgaactgcaccgaggtccccgtggccatccacgccgaccagctgacgcccacctggcgggtgtacagcaccgggtccaacgtcttccagacccgcgccggctgcctcatcggggcggagcacgtgaacaacagctacgagtgcgacatccccatcggcgccggcatctgcgcctcctaccagacgcagaccaacagcccgcggcgcgcccggtccgtggcgagccagtccatcatcgcctacaccatgagcctgggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctcctgctgcagtacgggagcttctgcacccagctcaaccgcgcgctgacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacacctccgccctcctggcgggcaccatcacgagcgggtggaccttcggcgccggcgccgccctgcagatccccttcgcgatgcagatggcctaccggttcaacgggatcggcgtcacccagaacgtgctctacgagaaccagaagctgatcgccaaccagttcaactccgccatcgggaagatccaggacagcctgtccagcaccgcctccgcgctcggcaagctgcaggacgtggtcaaccagaacgcccaggccctgaacacgctcgtgaagcagctgagctccaacttcggggccatcagctccgtgctgaacgacatcctcagccgcctggacccgcccgaggccgaggtccagatcgaccggctgatcaccggccgcctccagtccctgcagacctacgtgacccagcagctgatccgggcggccgagatccgcgccagcgccaacctcgccgcgaccaagatgagcgagtgcgtgctgggccagtccaagcgggtcgacttctgcgggaagggctaccacctgatgagcttcccccagtccgcgccccacggggtggtgttcctccacgtcacgtacgtgcccgcccaggagaagaacttcaccaccgccccggccatctgccacgacggcaaggcccacttcccccgcgagggggtcttcgtgagcaacggcacccactggttcgtgacgcagcggaacttctacgagccccagatcatcaccaccgacaacaccttcgtctccggcaactgcgacgtggtgatcgggatcgtcaacaacacggtgtacgaccccctgcagccggagctggacagcttcaaggaggagctcgacaagtacttcaagaaccacacctcccccgacgtggacctgggcgacatcagcgggatcaacgcctccgtcgtgaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtcatggtgaccatcatgctctgctgcatgacctcctgctgcagctgcctgaagggctgctgctcctgcgggagctgctgcaagttcgacgaggacgactccgagccggtgctgaagggcgtcaagctccactacacgtga

SEQ ID NO: 23100 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_N501Y_D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtga

SEQ ID NO: 23101 - RNA, 3816 nt, synthetic construct
  misc_feature 1..3816: note = SARS-CoV-2/Wuhan/WIV05/2019__EPI_ISL_402128 spike protein CDS gc (1-1273)(K986P_V987P_H69del_V70del_D614G)
  source 1..3816: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtggcctactccaacaacagcatcgccatccccaccaacttcacgatctccgtcaccaccgagatcctgcccgtgagcatgaccaagacgagcgtggactgcaccatgtacatctgcggcgactccaccgagtgcagcaacctcctgctgcagtacgggtccttctgcacccagctcaaccgcgcgctgacgggcatcgccgtcgagcaggacaagaacacccaggaggtgttcgcccaggtgaagcagatctacaagacgcccccgatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtcctctacgagaaccagaagctgatcgccaaccagttcaacagcgccatcgggaagatccaggactccctgagctccaccgccagcgcgctcggcaagctgcaggacgtggtgaaccagaacgcccaggccctgaacacgctcgtcaagcagctgtccagcaacttcggggccatctccagcgtgctgaacgacatcctctcccgcctggacccgcccgaggccgaggtgcagatcgaccggctgatcaccggccgcctccagagcctgcagacctacgtcacccagcagctgatccgggcggccgagatccgcgccagcgccaacctcgccgcgaccaagatgtccgagtgcgtgctgggccagagcaagcgggtggacttctgcgggaagggctaccacctgatgtccttcccccagagcgcgccccacggggtcgtgttcctccacgtgacgtacgtccccgcccaggagaagaacttcaccaccgccccggccatctgccacgacggcaaggcccacttcccccgcgagggggtgttcgtctccaacggcacccactggttcgtgacgcagcggaacttctacgagccccagatcatcaccaccgacaacaccttcgtgagcggcaactgcgacgtcgtgatcgggatcgtgaacaacacggtctacgaccccctgcagccggagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtgatggtcaccatcatgctctgctgcatgaccagctgctgctcctgcctgaagggctgctgcagctgcgggtcctgctgcaagttcgacgaggacgacagcgagccggtgctgaagggcgtgaagctccactacacgtga

SEQ ID NO: 23102 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_Y453F_D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtga

SEQ ID NO: 23103 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_D614G_I692V)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcgtcatcgcctacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgcgctgacgggcatcgccgtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtcctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtgctctacgagaaccagaagctgatcgccaaccagttcaacagcgccatcgggaagatccaggactccctgagctccaccgccagcgcgctcggcaagctgcaggacgtcgtgaaccagaacgcccaggccctgaacacgctcgtgaagcagctgtccagcaacttcggggccatctccagcgtcctgaacgacatcctctcccgcctggacccgcccgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgcgccccacggggtggtcttcctccacgtgacgtacgtccccgcccaggagaagaacttcaccaccgccccggccatctgccacgacggcaaggcccacttcccccgcgagggggtgttcgtgtccaacggcacccactggttcgtcacgcagcggaacttctacgagccccagatcatcaccaccgacaacaccttcgtgagcggcaactgcgacgtggtcatcgggatcgtgaacaacacggtgtacgaccccctgcagccggagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccctggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagccggtcctgaagggcgtgaagctccactacacgtga

SEQ ID NO: 23104 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_D614G_M1229I)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatcgtgaccatcatgctctgctgcatgaccagctgctgctcctgcctgaagggctgctgcagctgcgggtcctgctgcaagttcgacgaggacgacagcgagccggtgctgaagggcgtcaagctccactacacgtga

SEQ ID NO: 23105 - RNA, 3816 nt, synthetic construct
  misc_feature 1..3816: note = SARS-CoV-2/Wuhan/WIV05/2019__EPI_ISL_402128 spike protein CDS gc (1-1273)(K986P_V987P_H69del_V70del_A222V_Y453F_S477N_D614G_ I692V)
  source 1..3816: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgtcctcgagcccctggtggacctgcccatcggcatcaacatcacccgcttccagaccctcctggccctgcaccggtcctacctcacgccgggggacagcagctccggctggaccgccggcgcggccgcctactacgtggggtacctgcagccccgcaccttcctgctcaagtacaacgagaacggcaccatcacggacgccgtcgactgcgcgctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggccgactacagcgtgctgtacaactccgcgagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcctggaacagcaacaacctcgactccaaggtcgggggcaactacaactacctgttccgcctgttccgcaagagcaacctcaagcccttcgagcgggacatctccaccgagatctaccaggcgggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgccgtccgcgacccccagaccctggagatcctcgacatcaccccctgcagcttcggcggggtgagcgtgatcacgccgggcaccaacacctccaaccaggtcgcggtgctgtaccagggcgtgaactgcaccgaggtccccgtggccatccacgccgaccagctgacgcccacctggcgggtgtacagcaccgggtccaacgtcttccagacccgcgccggctgcctcatcggggccgagcacgtgaacaacagctacgagtgcgacatccccatcggcgcgggcatctgcgcctcctaccagacgcagaccaacagcccgcggcgcgcccggtccgtggccagccagtccgtcatcgcgtacaccatgagcctgggggccgagaactccgtggcctacagcaacaactccatcgccatccccaccaacttcacgatcagcgtgaccaccgagatcctgcccgtctccatgaccaagacgagcgtggactgcaccatgtacatctgcggcgacagcaccgagtgctccaacctcctgctgcagtacgggagcttctgcacccagctcaaccgcgccctgacgggcatcgcggtggagcaggacaagaacacccaggaggtcttcgcccaggtgaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacacctccgccctcctggccggcaccatcacgagcgggtggaccttcggcgcgggcgccgccctgcagatccccttcgccatgcagatggcgtaccggttcaacgggatcggcgtgacccagaacgtgctctacgagaaccagaagctgatcgccaaccagttcaactccgccatcgggaagatccaggacagcctgtccagcaccgcctccgccctcggcaagctgcaggacgtcgtgaaccagaacgcgcaggccctgaacacgctcgtgaagcagctgagctccaacttcggggccatcagctccgtcctgaacgacatcctcagccgcctggacccgcccgaggccgaggtgcagatcgaccggctgatcaccggccgcctccagtccctgcagacctacgtgacccagcagctgatccgggccgcggagatccgcgccagcgccaacctcgccgccaccaagatgagcgagtgcgtcctgggccagtccaagcgggtggacttctgcgggaagggctaccacctgatgagcttcccccagtccgcgccccacggggtggtcttcctccacgtgacgtacgtccccgcccaggagaagaacttcaccaccgccccggccatctgccacgacggcaaggcgcacttcccccgcgagggggtgttcgtgagcaacggcacccactggttcgtcacgcagcggaacttctacgagccccagatcatcaccaccgacaacaccttcgtgtccggcaactgcgacgtggtcatcgggatcgtgaacaacacggtgtacgaccccctgcagccggagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccctggtacatctggctgggcttcatcgccgggctgatcgccatcgtgatggtgaccatcatgctctgctgcatgacctcctgctgcagctgcctgaagggctgctgctcctgcgggagctgctgcaagttcgacgaggacgactccgagccggtcctgaagggcgtgaagctccactacacgtga

SEQ ID NO: 23106 - RNA, 3816 nt, synthetic construct
  misc_feature 1..3816: note = SARS-CoV-2/Wuhan/WIV05/2019__EPI_ISL_402128 spike protein CDS gc (1-1273)(K986P_V987P_H69del_V70del_Y453F_D614G_I692V_M1229I )
  source 1..3816: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcgtgatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatcgtgaccatcatgctctgctgcatgaccagctgctgctcctgcctgaagggctgctgcagctgcgggtcctgctgcaagttcgacgaggacgacagcgagccggtgctgaagggcgtcaagctccactacacgtga

SEQ ID NO: 23107 - RNA, 3813 nt, synthetic construct
  misc_feature 1..3813: note = SARS-CoV-2/Wuhan/WIV05/2019__EPI_ISL_402128 spike protein CDS gc (1-1273)(K986P_V987P_K986P_V987P_H69del_V70del_Y144del_N501 Y_A570D_D614G_P681H_T716I_S982A_D1118H)
  source 1..3813: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgacgacacgaccgacgccgtgcgcgacccccagaccctggagatcctcgacatcaccccctgcagcttcggcggggtctccgtgatcacgccgggcaccaacaccagcaaccaggtggcggtcctgtaccagggcgtgaactgcaccgaggtgcccgtcgccatccacgccgaccagctgacgcccacctggcgggtgtactccaccgggagcaacgtgttccagacccgcgccggctgcctcatcggggccgagcacgtcaacaactcctacgagtgcgacatccccatcggcgcgggcatctgcgccagctaccagacgcagaccaactcccaccggcgcgcccggagcgtggcctcccagagcatcatcgcgtacaccatgtccctgggggccgagaacagcgtggcctactccaacaacagcatcgccatcccgatcaacttcaccatctccgtcacgaccgagatcctgcccgtgagcatgaccaagaccagcgtggactgcacgatgtacatctgcggcgactccaccgagtgcagcaacctcctgctgcagtacgggtccttctgcacccagctcaaccgcgccctgaccggcatcgcggtcgagcaggacaagaacacgcaggaggtgttcgcccaggtgaagcagatctacaagaccccgcccatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgccgcgcgcgacctgatctgcgcccagaagttcaacgggctgaccgtgctgcccccgctcctgacggacgagatgatcgcccagtacaccagcgccctcctggccggcaccatcacctccgggtggacgttcggcgcgggcgccgccctgcagatccccttcgccatgcagatggcgtaccggttcaacgggatcggcgtgacccagaacgtcctctacgagaaccagaagctgatcgccaaccagttcaacagcgccatcgggaagatccaggactccctgagctccaccgccagcgccctcggcaagctgcaggacgtggtgaaccagaacgcgcaggccctgaacaccctcgtcaagcagctgtccagcaacttcggggccatctccagcgtgctgaacgacatcctcgcccgcctggacccgcccgaggccgaggtgcagatcgaccggctgatcacgggccgcctccagtccctgcagacctacgtcacccagcagctgatccgggcggccgagatccgcgccagcgccaacctcgccgcgaccaagatgagcgagtgcgtgctgggccagtccaagcgggtggacttctgcgggaagggctaccacctgatgagcttcccccagtccgcgccccacggggtcgtgttcctccacgtgacctacgtccccgcccaggagaagaacttcacgaccgcccccgccatctgccacgacggcaaggcccacttcccgcgcgagggggtgttcgtcagcaacggcacccactggttcgtgacccagcggaacttctacgagccccagatcatcacgacccacaacaccttcgtgtccggcaactgcgacgtcgtgatcgggatcgtgaacaacaccgtctacgaccccctgcagcccgagctggacagcttcaaggaggagctcgacaagtacttcaagaaccacacgtccccggacgtggacctgggcgacatcagcgggatcaacgcctccgtggtcaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtgatggtcaccatcatgctctgctgcatgacctcctgctgcagctgcctgaagggctgctgctcctgcgggagctgctgcaagttcgacgaggacgactccgagcccgtgctgaagggcgtgaagctccactacacctga

SEQ ID NO: 23108 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_K986P_V987P_K417N_E484K_N501Y_D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtga

SEQ ID NO: 23109 - RNA, 3813 nt, synthetic construct
  misc_feature 1..3813: note = SARS-CoV-2/Wuhan/WIV05/2019__EPI_ISL_402128 spike protein CDS gc (1-1273)(K986P_V987P_K986P_V987P_L18F_D80A_D215G_L242del_A2 43del_L244del_R246I_K417N_E484K_N501Y_D614G_A701V)
  source 1..3813: mol_type = other RNA
atgttcgtgttcctggtcctcctgcccctggtgagctcccagtgcgtgaacttcaccacccgcacgcagctcccgcccgcctacaccaacagcttcacccggggcgtctactaccccgacaaggtgttccgctccagcgtgctgcactccacccaggacctgttcctccccttcttcagcaacgtcacgtggttccacgccatccacgtgtccgggaccaacggcaccaagcggttcgcgaacccggtgctgcccttcaacgacggggtctacttcgccagcaccgagaagtccaacatcatccgcggctggatcttcgggacgaccctggacagcaagacccagtccctcctgatcgtgaacaacgccaccaacgtggtcatcaaggtgtgcgagttccagttctgcaacgaccccttcctgggcgtgtactaccacaagaacaacaagagctggatggagtccgagttccgggtctacagctccgccaacaactgcacgttcgagtacgtgagccagcccttcctcatggacctggagggcaagcaggggaacttcaagaacctgcgcgagttcgtgttcaagaacatcgacggctacttcaagatctactccaagcacaccccgatcaacctcgtccgggggctgccccagggcttcagcgccctggagcccctcgtggacctgcccatcgggatcaacatcacccgcttccagaccctgcacatctcctacctcacgccgggcgacagcagctccggctggaccgcgggggccgccgcctactacgtgggctacctgcagccccggaccttcctgctcaagtacaacgagaacgggaccatcacggacgcggtcgactgcgccctggaccccctgagcgagaccaagtgcaccctcaagtccttcaccgtggagaagggcatctaccagacgagcaacttccgcgtgcagcccaccgagtccatcgtccggttcccgaacatcaccaacctgtgccccttcggcgaggtgttcaacgccacccgcttcgccagcgtctacgcctggaaccggaagcgcatctccaactgcgtggcggactacagcgtgctgtacaactccgccagcttctccacgttcaagtgctacggggtcagccccaccaagctcaacgacctgtgcttcaccaacgtgtacgccgactccttcgtgatccggggcgacgaggtccgccagatcgcccccgggcagaccggcaacatcgccgactacaactacaagctgccggacgacttcacggggtgcgtgatcgcgtggaacagcaacaacctcgactccaaggtgggcggcaactacaactacctgtaccggctgttccgcaagagcaacctcaagcccttcgagcgggacatctccaccgagatctaccaggccgggagcaccccctgcaacggcgtcaaggggttcaactgctacttccccctgcagtcctacggcttccagccgacctacggggtgggctaccagccctaccgcgtggtcgtgctgagcttcgagctcctgcacgcccccgccacggtgtgcggccccaagaagtccaccaacctggtcaagaacaagtgcgtgaacttcaacttcaacgggctcaccggcaccggggtgctgaccgagagcaacaagaagttcctgccgttccagcagttcggccgggacatcgccgacacgaccgacgcggtccgcgacccccagaccctcgagatcctggacatcaccccctgcagcttcgggggcgtgtccgtgatcacgccgggcaccaacaccagcaaccaggtcgccgtgctgtaccagggggtgaactgcaccgaggtccccgtggccatccacgccgaccagctgacgcccacctggcgcgtgtactccaccggcagcaacgtcttccagacccgggccgggtgcctcatcggcgcggagcacgtgaacaactcctacgagtgcgacatccccatcggcgccgggatctgcgccagctaccagacgcagaccaactccccgcgccgggcccgcagcgtggcgtcccagagcatcatcgcctacaccatgtccctgggcgtcgagaacagcgtggcctactccaacaacagcatcgccatccccaccaacttcacgatctccgtgaccaccgagatcctgcccgtcagcatgaccaagacgagcgtggactgcaccatgtacatctgcggggactccaccgagtgcagcaacctcctgctgcagtacggctccttctgcacccagctcaaccgggccctgacggggatcgcggtggagcaggacaagaacacccaggaggtcttcgcccaggtgaagcagatctacaagacgcccccgatcaaggacttcggcggcttcaacttcagccagatcctgcccgacccctccaagcccagcaagcgctccttcatcgaggacctcctgttcaacaaggtgaccctggccgacgccgggttcatcaagcagtacggcgactgcctcggggacatcgccgcgcgggacctgatctgcgcccagaagttcaacggcctgaccgtcctcccgcccctgctgaccgacgagatgatcgcccagtacaccagcgccctcctggccgggaccatcacgtccggctggaccttcggcgcgggggccgccctgcagatccccttcgccatgcagatggcgtaccgcttcaacggcatcggggtgacccagaacgtgctctacgagaaccagaagctgatcgccaaccagttcaacagcgccatcggcaagatccaggactccctgagctccaccgccagcgccctcgggaagctgcaggacgtcgtgaaccagaacgcgcaggccctgaacacgctcgtgaagcagctgtccagcaacttcggcgccatctccagcgtcctgaacgacatcctctcccggctggacccgcccgaggccgaggtgcagatcgaccgcctgatcaccggccggctccagagcctgcagacctacgtgacccagcagctgatccgcgccgcggagatccgggccagcgccaacctcgccgccaccaagatgtccgagtgcgtcctggggcagagcaagcgcgtggacttctgcggcaaggggtaccacctgatgtccttcccccagagcgcgccccacggcgtggtcttcctccacgtgacgtacgtccccgcccaggagaagaacttcaccaccgccccggccatctgccacgacgggaaggcgcacttcccccgggagggcgtgttcgtgtccaacggcacccactggttcgtcacgcagcgcaacttctacgagccccagatcatcaccaccgacaacaccttcgtgagcgggaactgcgacgtggtcatcggcatcgtgaacaacacggtgtacgaccccctgcagccggagctggactccttcaaggaggagctcgacaagtacttcaagaaccacaccagccccgacgtcgacctgggggacatctccggcatcaacgccagcgtggtgaacatccagaaggagatcgaccggctgaacgaggtcgccaagaacctcaacgagtccctgatcgacctgcaggagctcggcaagtacgagcagtacatcaagtggccctggtacatctggctggggttcatcgccggcctgatcgccatcgtgatggtgaccatcatgctctgctgcatgaccagctgctgctcctgcctgaaggggtgctgcagctgcggctcctgctgcaagttcgacgaggacgacagcgagccggtcctgaagggggtgaagctccactacacgtga

SEQ ID NO: 23110 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_K986P_V987P_E484K_D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtga

SEQ ID NO: 23111 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_K986P_V987P_L18F_T20N_P26S_D138Y_R190S _K417T_E484K_N501Y_D614G_H655Y_T1027I)
  source 1..3822: mol_type = other RNA
atgttcgtgttcctggtcctcctgcccctggtgagctcccagtgcgtgaacttcaccaaccgcacccagctcccgagcgcctacacgaactccttcacccggggcgtctactaccccgacaaggtgttccgcagctccgtgctgcacagcacccaggacctgttcctccccttcttctccaacgtcacctggttccacgccatccacgtgagcgggacgaacggcaccaagcggttcgacaaccccgtgctgccgttcaacgacggggtctacttcgcgtccaccgagaagtccaacatcatccgcggctggatcttcgggaccacgctggactccaagacccagagcctcctgatcgtgaacaacgccaccaacgtggtcatcaaggtgtgcgagttccagttctgcaactaccccttcctgggcgtgtactaccacaagaacaacaagtcctggatggagagcgagttccgggtctactccagcgccaacaactgcaccttcgagtacgtgtcccagcccttcctcatggacctggagggcaagcaggggaacttcaagaacctgagcgagttcgtgttcaagaacatcgacggctacttcaagatctactccaagcacacgcccatcaacctcgtccgcgacctgccgcaggggttcagcgccctggagcccctcgtggacctgcccatcggcatcaacatcacccggttccagaccctgctcgccctgcaccgcagctacctgacccccggggactccagctccggctggacggcgggcgccgccgcctactacgtggggtacctccagccgcggaccttcctgctgaagtacaacgagaacggcaccatcaccgacgcggtcgactgcgccctcgaccccctgagcgagacgaagtgcaccctgaagtccttcaccgtggagaaggggatctaccagaccagcaacttccgcgtgcagcccacggagtccatcgtccggttccccaacatcaccaacctctgcccgttcggcgaggtgttcaacgccacccgcttcgccagcgtctacgcctggaaccggaagcgcatctccaactgcgtggcggactacagcgtgctgtacaactccgccagcttctccaccttcaagtgctacggcgtcagccccacgaagctgaacgacctctgcttcaccaacgtgtacgccgactccttcgtgatccgcggggacgaggtccggcagatcgcccccggccagaccgggaccatcgccgactacaactacaagctgcccgacgacttcacgggctgcgtgatcgcgtggaacagcaacaacctggactccaaggtcgggggcaactacaactacctctaccggctgttccgcaagagcaacctgaagccgttcgagcgggacatctccaccgagatctaccaggccggcagcaccccctgcaacggggtgaagggcttcaactgctacttccccctccagagctacgggttccagcccacctacggcgtggggtaccagccgtaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgcccttccagcagttcgggcgggacatcgccgacacgaccgacgcggtccgcgacccgcagaccctggagatcctggacatcaccccctgcagcttcggcggggtgtccgtgatcacgcccggcaccaacaccagcaaccaggtcgccgtgctctaccagggcgtgaactgcaccgaggtcccggtggccatccacgccgaccagctgacgcccacctggcgcgtgtactccaccgggagcaacgtcttccagacccgggccggctgcctgatcggggcggagtacgtgaacaactcctacgagtgcgacatccccatcggcgccggcatctgcgccagctaccagacgcagaccaacagcccccgccgggcccgcagcgtggcgtcccagagcatcatcgcctacaccatgtccctcggggccgagaacagcgtcgcctactccaacaacagcatcgccatcccgaccaacttcacgatcagcgtgaccaccgagatcctgcccgtgtccatgaccaagacgagcgtcgactgcaccatgtacatctgcggcgactccaccgagtgcagcaacctgctcctgcagtacgggtccttctgcacccagctgaaccgggcgctcacgggcatcgccgtggagcaggacaagaacacccaggaggtgttcgcccaggtcaagcagatctacaagaccccgcccatcaaggacttcgggggcttcaacttcagccagatcctgcccgacccctccaagcccagcaagcgctccttcatcgaggacctcctgttcaacaaggtgaccctggccgacgccggcttcatcaagcagtacggggactgcctgggcgacatcgcggcccgggacctcatctgcgcccagaagttcaacgggctgacggtgctgcccccgctcctgaccgacgagatgatcgcccagtacaccagcgccctgctcgcgggcaccatcacgtccgggtggaccttcggcgccggcgccgccctgcagatccccttcgcgatgcagatggcctaccgcttcaacgggatcggcgtcacccagaacgtgctgtacgagaaccagaagctcatcgccaaccagttcaacagcgccatcgggaagatccaggactccctgagctccaccgccagcgcgctgggcaagctccaggacgtggtcaaccagaacgcccaggccctgaacacgctggtgaagcagctctccagcaacttcggggccatctccagcgtgctgaacgacatcctgagccggctcgacccgcccgaggccgaggtccagatcgaccgcctgatcaccggccggctgcagtccctccagacctacgtgacccagcagctgatccgcgcggccgagatccgggccagcgccaacctggccgcgatcaagatgtccgagtgcgtgctcggccagagcaagcgcgtcgacttctgcgggaagggctaccacctgatgtccttcccccagagcgcgccccacggggtggtgttcctgcacgtcacctacgtgcccgcccaggagaagaacttcacgaccgcccccgccatctgccacgacggcaaggcccacttcccgcgggagggggtcttcgtgtccaacggcacccactggttcgtgacccagcgcaacttctacgagccccagatcatcacgaccgacaacaccttcgtcagcggcaactgcgacgtggtgatcgggatcgtcaacaacaccgtgtacgaccccctccagcccgagctggactccttcaaggaggagctggacaagtacttcaagaaccacacgagcccggacgtggacctcggcgacatctccgggatcaacgccagcgtcgtgaacatccagaaggagatcgaccggctgaacgaggtggccaagaacctgaacgagtccctcatcgacctgcaggagctgggcaagtacgagcagtacatcaagtggccctggtacatctggctcggcttcatcgccgggctgatcgcgatcgtcatggtgaccatcatgctgtgctgcatgaccagctgctgctcctgcctcaagggctgctgcagctgcgggtcctgctgcaagttcgacgaggacgacagcgagcccgtgctgaagggcgtcaagctgcactacacctga

SEQ ID NO: 23112 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_K986P_V987P_S13I_W152C_L452R_D614G)
  source 1..3822: mol_type = other RNA
atgttcgtgttcctggtcctcctgcccctggtgagcatccagtgcgtgaacctcaccacccgcacgcagctgccgcccgcctacaccaactccttcacccggggcgtctactaccccgacaaggtgttccgcagctccgtgctgcacagcacccaggacctcttcctgcccttcttctccaacgtcacgtggttccacgccatccacgtgagcgggaccaacggcaccaagcggttcgacaacccggtgctgcccttcaacgacggggtctacttcgcgtccaccgagaagtccaacatcatccgcggctggatcttcgggacgaccctcgacagcaagacccagagcctgctgatcgtgaacaacgccaccaacgtggtcatcaaggtgtgcgagttccagttctgcaacgaccccttcctcggcgtgtactaccacaagaacaacaagtcctgcatggagagcgagttccgggtctactccagcgccaacaactgcacgttcgagtacgtgtcccagcccttcctgatggacctggagggcaagcaggggaacttcaagaacctccgcgagttcgtgttcaagaacatcgacggctacttcaagatctacagcaagcacaccccgatcaacctggtccgggacctgccccaggggttctccgccctcgagcccctggtggacctgcccatcggcatcaacatcacccgcttccagaccctcctggccctgcaccggagctacctcacgccgggggactccagcagcggctggaccgcgggcgccgccgcctactacgtggggtacctgcagccccgcaccttcctgctcaagtacaacgagaacggcaccatcacggacgcggtcgactgcgccctggaccccctgtccgagaccaagtgcaccctcaagagcttcaccgtggagaaggggatctaccagacgtccaacttccgggtgcagcccaccgagagcatcgtccgcttcccgaacatcaccaacctgtgccccttcggcgaggtgttcaacgccacccggttcgcctccgtctacgcctggaaccgcaagcggatcagcaactgcgtggcggactactccgtgctgtacaacagcgcctccttcagcacgttcaagtgctacggcgtctcccccaccaagctcaacgacctgtgcttcaccaacgtgtacgccgacagcttcgtgatccgcggggacgaggtccggcagatcgcccccggccagaccgggaagatcgccgactacaactacaagctgccggacgacttcacgggctgcgtgatcgcgtggaactccaacaacctcgacagcaaggtcgggggcaactacaactaccgctaccggctgttccgcaagtccaacctgaagcccttcgagcgggacatcagcaccgagatctaccaggccggctccaccccctgcaacggggtggagggcttcaactgctacttccccctccagagctacgggttccagccgaccaacggcgtggggtaccagccctaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgccgttccagcagttcgggcgcgacatcgccgacacgaccgacgcggtccgggacccccagaccctggagatcctggacatcaccccctgcagcttcggcggggtgagcgtgatcacgccgggcaccaacacctccaaccaggtcgccgtgctctaccagggcgtgaactgcaccgaggtccccgtggccatccacgccgaccagctgacgcccacctggcgcgtgtacagcaccgggtccaacgtcttccagacccgggccggctgcctgatcggggcggagcacgtgaacaacagctacgagtgcgacatccccatcggcgccggcatctgcgcctcctaccagacgcagaccaacagcccgcgccgggcccgctccgtggcgagccagtccatcatcgcctacaccatgagcctcggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctgctcctgcagtacgggagcttctgcacccagctgaaccgggcgctcacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcgcagcttcatcgaggacctcctgttcaacaaggtgaccctggccgacgccggcttcatcaagcagtacggggactgcctgggcgacatcgcggcccgggacctcatctgcgcccagaagttcaacgggctgaccgtgctgccgcccctcctgaccgacgagatgatcgcccagtacacctccgccctgctcgcgggcaccatcacgagcgggtggaccttcggcgccggcgccgccctgcagatccccttcgcgatgcagatggcctaccgcttcaacgggatcggcgtcacccagaacgtgctgtacgagaaccagaagctcatcgccaaccagttcaactccgccatcgggaagatccaggacagcctgtccagcaccgcctccgcgctgggcaagctccaggacgtggtcaaccagaacgcccaggccctgaacacgctggtgaagcagctcagctccaacttcggggccatcagctccgtgctgaacgacatcctgagccggctcgacccgcccgaggccgaggtccagatcgaccgcctgatcaccggccggctgcagtccctccagacctacgtgacccagcagctgatccgcgcggccgagatccgggccagcgccaacctggccgcgaccaagatgagcgagtgcgtgctcggccagtccaagcgcgtcgacttctgcgggaagggctaccacctgatgagcttcccccagtccgcgccccacggggtggtgttcctgcacgtcacgtacgtgcccgcccaggagaagaacttcaccaccgccccggccatctgccacgacggcaaggcccacttcccccgggagggggtcttcgtgagcaacggcacccactggttcgtgacgcagcgcaacttctacgagccccagatcatcaccaccgacaacaccttcgtctccggcaactgcgacgtggtgatcgggatcgtcaacaacacggtgtacgaccccctccagccggagctggacagcttcaaggaggagctggacaagtacttcaagaaccacacctcccccgacgtggacctcggcgacatcagcgggatcaacgcctccgtcgtgaacatccagaaggagatcgaccggctgaacgaggtggccaagaacctgaacgagagcctcatcgacctgcaggagctgggcaagtacgagcagtacatcaagtggccctggtacatctggctcggcttcatcgccgggctgatcgcgatcgtcatggtgaccatcatgctgtgctgcatgacctcctgctgcagctgcctcaagggctgctgctcctgcgggagctgctgcaagttcgacgaggacgactccgagccggtgctgaagggcgtcaagctgcactacacgtga

SEQ ID NO: 23113 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P)
  source 1..3822: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccaggacgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23114 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_ D614G)
  source 1..3822: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23115 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_A222V_D614G)
  source 1..3822: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23116 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_N439K_D614G)
  source 1..3822: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaagaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23117 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_S477N_D614G)
  source 1..3822: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23118 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_N501Y_D614G)
  source 1..3822: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23119 - RNA, 3816 nt, synthetic construct
  misc_feature 1..3816: note = SARS-CoV-2/Wuhan/WIV05/2019__EPI_ISL_402128 spike protein CDS gc (1-1273)(K986P_V987P_H69del_V70del_D614G)
  source 1..3816: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23120 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_Y453F_D614G)
  source 1..3822: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23121 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_D614G_I692V)
  source 1..3822: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23122 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_D614G_M1229I)
  source 1..3822: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23123 - RNA, 3816 nt, synthetic construct
  misc_feature 1..3816: note = SARS-CoV-2/Wuhan/WIV05/2019__EPI_ISL_402128 spike protein CDS gc (1-1273)(K986P_V987P_H69del_V70del_A222V_Y453F_S477N_D614G_ I692V)
  source 1..3816: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23124 - RNA, 3816 nt, synthetic construct
  misc_feature 1..3816: note = SARS-CoV-2/Wuhan/WIV05/2019__EPI_ISL_402128 spike protein CDS gc (1-1273)(K986P_V987P_H69del_V70del_Y453F_D614G_I692V_M1229I )
  source 1..3816: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23125 - RNA, 3813 nt, synthetic construct
  misc_feature 1..3813: note = SARS-CoV-2/Wuhan/WIV05/2019__EPI_ISL_402128 spike protein CDS gc (1-1273)(K986P_V987P_K986P_V987P_H69del_V70del_Y144del_N501 Y_A570D_D614G_P681H_T716I_S982A_D1118H)
  source 1..3813: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgacgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcacaccggagggcaaggagcgtggccagccagagcatcatcgcctacaccatgagcctgggcgccgagaacagcgtggcctacagcaacaacagcatcgccatccccatcaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctggcccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23126 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_K986P_V987P_K417N_E484K_N501Y_D614G)
  source 1..3822: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23127 - RNA, 3813 nt, synthetic construct
  misc_feature 1..3813: note = SARS-CoV-2/Wuhan/WIV05/2019__EPI_ISL_402128 spike protein CDS gc (1-1273)(K986P_V987P_K986P_V987P_L18F_D80A_D215G_L242del_A2 43del_L244del_R246I_K417N_E484K_N501Y_D614G_A701V)
  source 1..3813: mol_type = other RNA
atgttcgtgttcctggtgctgctgcccctggtgagcagccagtgcgtgaacttcaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgccaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcggggcctgccccagggcttctcagccctggagcccctggtggacctgcccatcggcatcaacatcacccggttccagaccctgcacatcagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgtggagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23128 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_K986P_V987P_E484K_D614G)
  source 1..3822: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23129 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_K986P_V987P_L18F_T20N_P26S_D138Y_R190S _K417T_E484K_N501Y_D614G_H655Y_T1027I)
  source 1..3822: mol_type = other RNA
atgttcgtgttcctggtgctgctgcccctggtgagcagccagtgcgtgaacttcaccaaccggacccagctgccaagcgcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaactaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgagcgagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaccatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagtacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccatcaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23130 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_K986P_V987P_S13I_W152C_L452R_D614G)
  source 1..3822: mol_type = other RNA
atgttcgtgttcctggtgctgctgcccctggtgagcatccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctgcatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactaccgctaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23131 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P)
  source 1..3822: mol_type = other RNA
atgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccaggacgtgaactgcaccgaggtgcccgtggccatccacgccgaccagctgacccccacctggcgggtgtacagcaccggaagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgattgcctgggcgacatcgccgctcgggacctgatctgcgcccagaagttcaacgggctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggcgtgttcgtgagcaacggaacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctga

SEQ ID NO: 23132 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_ D614G)
  source 1..3822: mol_type = other RNA
atgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctga

SEQ ID NO: 23133 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_A222V_D614G)
  source 1..3822: mol_type = other RNA
atgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtcagcgtgatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagcccccggcgggcccggagcgtggccagccagagcatcatcgcctacaccatgagcttaggcgccgagaacagcgtggcctacagcaacaacagcatcgccatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttttgcggcaagggctaccacctgatgagcttcccccagagcgctccccacggcgtggtgttcctccacgtcacatacgtgcccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctga

SEQ ID NO: 23134 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_N439K_D614G)
  source 1..3822: mol_type = other RNA
atgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaagaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggatcccccagaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctga

SEQ ID NO: 23135 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_S477N_D614G)
  source 1..3822: mol_type = other RNA
atgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcaacaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgcgcctcctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaatttcggcgccatcagcagcgtgctgaacgacatcctgtcaaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctga

SEQ ID NO: 23136 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_N501Y_D614G)
  source 1..3822: mol_type = other RNA
atgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggatcccccagaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctga

SEQ ID NO: 23137 - RNA, 3816 nt, synthetic construct
  misc_feature 1..3816: note = SARS-CoV-2/Wuhan/WIV05/2019__EPI_ISL_402128 spike protein CDS gc (1-1273)(K986P_V987P_H69del_V70del_D614G)
  source 1..3816: mol_type = other RNA
atgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtgcccgcccaggagaagaacttcaccaccgcccccgccatttgccacgacggcaaggcccacttcccccgggagggagtcttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctga

SEQ ID NO: 23138 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_Y453F_D614G)
  source 1..3822: mol_type = other RNA
atgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctga

SEQ ID NO: 23139 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_D614G_I692V)
  source 1..3822: mol_type = other RNA
atgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtcacatacgtgcccgcccaggagaagaacttcaccaccgcccccgccatctgccacgacggcaaggcccacttcccccgggagggagtgttcgtgagcaacggcacccactggttcgtgacccagcggaacttctacgagcctcagattatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctga

SEQ ID NO: 23140 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_D614G_M1229I)
  source 1..3822: mol_type = other RNA
atgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctga

SEQ ID NO: 23141 - RNA, 3816 nt, synthetic construct
  misc_feature 1..3816: note = SARS-CoV-2/Wuhan/WIV05/2019__EPI_ISL_402128 spike protein CDS gc (1-1273)(K986P_V987P_H69del_V70del_A222V_Y453F_S477N_D614G_ I692V)
  source 1..3816: mol_type = other RNA
atgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcaacaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtgagcgtcatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgccggcatctgcgcttcctaccagacccagaccaacagcccccggcgggcccggagcgtggccagccagagcgtgatcgcctacaccatgagcttaggcgccgagaacagcgtggcctacagcaacaacagcatcgccatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaattttggcgccatcagcagcgtgctgaacgacatcctgtcaaggctggatcccccagaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttctgcggcaagggctaccacctgatgagcttcccccagagcgctccccacggcgtggtgttcctccacgtcacatacgtgcccgcccaggagaagaacttcaccaccgcccccgccatctgccacgacggcaaggcccacttcccccgggagggagtgttcgtgagcaacggcacccactggttcgtgacccagcggaacttctacgagcctcagattatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctga

SEQ ID NO: 23142 - RNA, 3816 nt, synthetic construct
  misc_feature 1..3816: note = SARS-CoV-2/Wuhan/WIV05/2019__EPI_ISL_402128 spike protein CDS gc (1-1273)(K986P_V987P_H69del_V70del_Y453F_D614G_I692V_M1229I )
  source 1..3816: mol_type = other RNA
atgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgctccccacggcgtggtgttcctccacgtgacatacgtccccgcccaggagaagaacttcaccaccgcccccgccatctgccacgacggcaaggcccacttcccccgggagggagtgttcgtgagcaacggcacccactggttcgtgacccagcggaacttctacgagcctcagattatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctga

SEQ ID NO: 23143 - RNA, 3813 nt, synthetic construct
  misc_feature 1..3813: note = SARS-CoV-2/Wuhan/WIV05/2019__EPI_ISL_402128 spike protein CDS gc (1-1273)(K986P_V987P_K986P_V987P_H69del_V70del_Y144del_N501 Y_A570D_D614G_P681H_T716I_S982A_D1118H)
  source 1..3813: mol_type = other RNA
atgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgacgacaccaccgacgccgtgcgggacccccagaccctggagatcctggacatcaccccatgcagcttcggcggcgtgagcgtgatcacccccggcacaaacaccagcaaccaggtcgcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagccaccggcgggcccggagcgtggccagccagagcatcatcgcctacaccatgagcttaggcgccgagaacagcgtggcctacagcaacaacagcatcgccatccccatcaacttcaccataagcgtgaccaccgagatcctgcctgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagaccccacccatcaaggacttcggcggcttcaacttcagccagatcctgcccgaccccagcaagcccagcaagcggagcttcatcgaggacctgctgttcaacaaggtgactctggccgacgccggcttcatcaagcagtacggcgattgcctgggggacatcgccgcccgggacctgatctgcgctcagaagttcaacggcctgaccgtgctgcctcccctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaacgacatcctggccaggctggacccacccgaggccgaggtgcagatcgaccggctgatcaccggccggctgcagagcctgcagacctacgtgacccagcagctgatccgggccgccgagattcgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacctacgtgcccgcccaggagaagaacttcacaaccgcccccgccatctgccacgacggcaaggcccacttcccccgggagggagtcttcgtgagcaacggcacccactggttcgtgacccagcggaacttctacgagccccagatcatcaccacccacaacaccttcgtgagcggcaactgcgacgtggtgatcggcatcgtgaacaacaccgtgtacgaccctctgcagcccgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccatggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctga

SEQ ID NO: 23144 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_K986P_V987P_K417N_E484K_N501Y_D614G)
  source 1..3822: mol_type = other RNA
atgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctga

SEQ ID NO: 23145 - RNA, 3813 nt, synthetic construct
  misc_feature 1..3813: note = SARS-CoV-2/Wuhan/WIV05/2019__EPI_ISL_402128 spike protein CDS gc (1-1273)(K986P_V987P_K986P_V987P_L18F_D80A_D215G_L242del_A2 43del_L244del_R246I_K417N_E484K_N501Y_D614G_A701V)
  source 1..3813: mol_type = other RNA
atgttcgtgttcctggtgctgctgcccctggtgagcagccagtgcgtgaacttcaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgccaacccagtgctgcccttcaacgacggcgtgtacttcgccagcaccgagaagtcaaacatcatccggggctggatctttggcaccaccctggacagcaagacacagagcctgctgatcgtgaacaacgctaccaacgtggtgatcaaggtgtgcgagttccagttctgcaacgaccccttcctgggcgtgtactaccacaagaacaacaagagctggatggagagcgagttccgggtctacagcagcgccaacaattgcaccttcgagtacgtgagccagcccttcctgatggacctggagggcaagcagggcaacttcaagaacctccgggagttcgtgttcaagaacatcgacggctacttcaagatctacagcaagcacacccccatcaacctggtgcggggactgccccagggcttcagcgccctggagcctctggtggatctgcccatcggcatcaacatcaccaggttccagaccctgcacatcagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcacccttaagagcttcaccgtggagaagggcatctaccagaccagcaacttccgggtgcagcccactgagagcattgtgcggttccccaacatcaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctattccgtaagagcaacctgaagccatttgagcgggacatcagcaccgagatctaccaggccggtagcaccccctgcaacggcgtgaagggcttcaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggacatcgccgacaccaccgatgcagtgcgggacccccagaccctggagatcctggacatcaccccatgcagcttcggcggcgtgagcgtcatcacccccggaacaaacaccagcaaccaggtggccgtgctgtaccagggcgtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcctgggcgtggagaacagcgtggcctacagcaacaacagcatcgccatccctaccaacttcaccataagcgtgaccaccgagatcctgcccgtgagcatgaccaagaccagcgtggactgtaccatgtacatctgcggcgacagcaccgagtgcagcaacctgttactgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggggactgcctgggcgacatcgccgcccgggacctgatctgcgctcagaagttcaacggcctgaccgtgctgccccctctgctgaccgatgagatgatcgcccagtacaccagcgccctgctggccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaactttggcgccatcagctcagtgctgaatgacatcctgagccggctggatcccccagaggccgaggtgcagatcgacaggctgatcaccggccggctgcagagcctgcagacctacgtgacccagcagctgatccgggccgccgagattcgggccagcgccaacctggccgcaaccaagatgagcgagtgcgtgctgggccagagcaagcgggtggacttctgcggcaagggctaccacctgatgagcttcccccagagcgctccccacggcgtggtgttcctgcacgtcacatacgtgcccgcccaggagaagaacttcaccaccgcccccgccatctgccacgacggaaaggcccacttcccccgggagggcgtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctcgacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctga

SEQ ID NO: 23146 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_K986P_V987P_E484K_D614G)
  source 1..3822: mol_type = other RNA
atgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctga

SEQ ID NO: 23147 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_K986P_V987P_L18F_T20N_P26S_D138Y_R190S _K417T_E484K_N501Y_D614G_H655Y_T1027I)
  source 1..3822: mol_type = other RNA
atgttcgtgttcctggtgctgctgcccctggtgagcagccagtgcgtgaacttcaccaaccggacccagctgcccagcgcctacaccaacagcttcacccggggcgtgtactaccctgacaaggtgttccggagcagcgtgctgcacagcacccaggacctgttcctgcccttcttcagcaacgtgacctggttccacgccatccacgtgagcggcaccaacggcaccaagcggttcgacaaccccgtgctgccattcaacgacggcgtgtacttcgccagcaccgagaagtcaaacatcatccggggctggatctttggcaccaccctggacagcaagacccagagcctgctgatcgtgaacaacgccacaaacgtggtgatcaaggtgtgcgagttccagttctgcaactaccccttcctgggcgtgtactaccacaagaacaacaagagctggatggagagcgagttccgggtctacagcagcgctaataactgcaccttcgagtacgtgagccagcccttcctgatggacctggagggcaagcagggcaacttcaagaacctcagcgagttcgtgttcaagaacatcgacggctacttcaagatctacagcaagcacacccccatcaacctggtgcgggatctgccccagggattcagcgccctggagcccctggtggacctgcctatcggcatcaacatcacccggttccagaccctgctggccctgcacaggagctacctgacccccggcgacagcagcagcggctggaccgccggcgccgccgcatactacgtgggctacctgcagccccggaccttcctgctgaagtacaacgagaacggcaccatcaccgacgccgtggactgcgccctggacccactgagcgagaccaagtgcaccctaaagagcttcaccgtggagaagggcatctaccagaccagcaacttccgggtgcagcccaccgagagcatcgtgcggttccccaacattactaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgctgacagcttcgtgatccggggcgacgaggtgcggcagatcgcccctggccagaccggcaccatcgccgactacaactacaagctgcccgacgacttcaccggctgcgtgatcgcctggaacagcaacaacctggacagcaaggtgggcggcaactacaactacctgtaccggctgttccgtaagagcaacctgaagccctttgagcgggacatcagcaccgagatctaccaggccggcagcaccccatgcaacggtgtgaagggcttcaactgctacttccccctgcagagctacggcttccagcccacctacggcgtgggctaccagccctaccgggtggtggtgctgagcttcgagctgctgcacgcccccgccaccgtgtgcggccccaaaaagagcaccaacctggtgaagaacaagtgcgtgaacttcaatttcaacggcctgaccggcaccggcgtgctgaccgagagcaacaagaagttcctgcctttccagcagttcggccgggacatcgccgataccaccgacgcagtgcgggacccccagaccctggagatcctggacatcaccccctgcagcttcggcggcgtgagcgtcatcaccccaggcacaaacaccagcaaccaggtggccgtgctgtaccagggagtgaactgcaccgaggtgcccgtggccatccacgccgaccagctgacccccacctggcgggtgtactccaccggcagcaacgtgttccagacccgggccggctgcctgatcggcgccgagtacgtgaacaacagctacgagtgcgacatccccatcggcgctggcatctgcgccagctaccagacccagaccaacagcccccggcgggcccggagcgtggccagccagagcatcatcgcctacaccatgagcctgggcgccgagaacagcgtggcctacagcaacaacagcatcgcgatccccaccaacttcaccatcagcgtgaccaccgagatattacctgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactccacccatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggacatcgccgctcgggatctgatctgcgcccagaagttcaacggcctgaccgtgctgcctcccctgctgaccgacgagatgatcgcccagtacaccagcgccctgctggccggcaccatcaccagcggctggaccttcggcgccggcgcagcccttcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagctcaaactttggcgccatcagcagcgtgctgaatgacatcctgagccggctggacccacccgaggccgaggtgcagatcgacaggctgatcaccggccggctgcagagcctgcagacctacgtgacccagcagctgatccgggccgccgagatccgggccagcgccaacctggcagccattaagatgagcgagtgcgtgctgggccagagcaagcgggtggacttctgcggcaagggctaccacctgatgagcttcccccagagcgctccccacggcgtggtgttcctgcacgtgacctacgtccccgcccaggagaagaacttcacaaccgcccccgccatctgccacgacggcaaggcccacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccctctccagcccgagctggacagcttcaaggaggagctggacaagtacttcaagaaccacaccagccccgacgtggacctgggcgatatcagcggcatcaacgccagcgtggtgaacatccagaaggagatcgaccggctgaacgaggtggccaagaacctgaacgagagcctgatcgacctgcaggagctgggcaagtacgagcagtacatcaagtggccatggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctga

SEQ ID NO: 23148 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_K986P_V987P_S13I_W152C_L452R_D614G)
  source 1..3822: mol_type = other RNA
atgttcgtgttcctggtgctgctgcccctggtgagcatccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctgcatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgtaccctaaagagcttcaccgtggagaagggcatctaccagaccagcaacttccgggtgcagcccactgagagcattgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactaccggtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgtgcctcctaccagacccagaccaacagcccccggcgggcccggagcgtggccagccagagcatcatcgcctacaccatgagcctgggcgccgagaacagcgtggcctacagcaacaacagcatcgcgatccctaccaacttcaccataagcgtgaccaccgagatcttacccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgctggccggcaccatcaccagcggctggaccttcggcgccggcgcagcccttcagatccccttcgccatgcagatggcctacaggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagcagcgtgctgaatgacatcctgtcacggctggatcccccagaggccgaggtgcagatcgaccggctgatcaccggccggctgcagagcctgcagacctacgtgacccagcagctgatccgggccgccgagattcgggccagcgccaacctggcagccaccaagatgagcgagtgcgtgctgggccagagcaagcgggtggacttttgcggcaagggctaccacctgatgagcttcccccagagcgctccccacggcgtggtgttcctgcacgtgacatacgtccccgcccaggagaagaacttcaccaccgcccccgccatctgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctccagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgttgcagctgcctgaagggctgctgcagctgcggcagctgctgcaagttcgacgaggacgacagcgagcccgtgctgaagggcgtgaagctgcactacacctga

SEQ ID NO: 23149 - RNA, 3822 nt, synthetic construct; identical to SEQ ID NO: 146
  misc_feature 1..3822: note = SARS-CoV-2/Wuhan/WIV05/2019__EPI_ISL_402128 spike protein CDS gc mod (1-1273)(K986P_V987P)
  source 1..3822: mol_type = other RNA

SEQ ID NO: 23150 - RNA, 3822 nt, synthetic construct
  misc_feature 1..3822: note = SARS-CoV-2/Wuhan/WIV05/2019__EPI_ISL_402128 spike protein CDS gc mod (1-1273)(K986P_V987P_ D614G)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23151 - RNA, 3822 nt, synthetic construct
  misc_feature 1..3822: note = SARS-CoV-2/Wuhan/WIV05/2019__EPI_ISL_402128 spike protein CDS gc mod (1-1273)(K986P_V987P_A222V_D614G)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23152 - RNA, 3822 nt, synthetic construct
  misc_feature 1..3822: note = SARS-CoV-2/Wuhan/WIV05/2019__EPI_ISL_402128 spike protein CDS gc mod (1-1273)(K986P_V987P_N439K_D614G)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23153 - RNA, 3822 nt, synthetic construct
  misc_feature 1..3822: note = SARS-CoV-2/Wuhan/WIV05/2019__EPI_ISL_402128 spike protein CDS gc mod (1-1273)(K986P_V987P_S477N_D614G)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23154 - RNA, 3822 nt, synthetic construct
  misc_feature 1..3822: note = SARS-CoV-2/Wuhan/WIV05/2019__EPI_ISL_402128 spike protein CDS gc mod (1-1273)(K986P_V987P_N501Y_D614G)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23155 - RNA, 3816 nt, synthetic construct
  misc_feature 1..3816: note = SARS-CoV-2/Wuhan/WIV05/2019__EPI_ISL_402128 spike protein CDS gc mod (1-1273)(K986P_V987P_H69del_V70del_D614G)
  source 1..3816: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23156 - RNA, 3822 nt, synthetic construct
  misc_feature 1..3822: note = SARS-CoV-2/Wuhan/WIV05/2019__EPI_ISL_402128 spike protein CDS gc mod (1-1273)(K986P_V987P_Y453F_D614G)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23157 - RNA, 3822 nt, synthetic construct
  misc_feature 1..3822: note = SARS-CoV-2/Wuhan/WIV05/2019__EPI_ISL_402128 spike protein CDS gc mod (1-1273)(K986P_V987P_D614G_I692V)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23158 - RNA, 3822 nt, synthetic construct
  misc_feature 1..3822: note = SARS-CoV-2/Wuhan/WIV05/2019__EPI_ISL_402128 spike protein CDS gc mod (1-1273)(K986P_V987P_D614G_M1229I)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23159 - RNA, 3816 nt, synthetic construct
  misc_feature 1..3816: note = SARS-CoV-2/Wuhan/WIV05/2019__EPI_ISL_402128 spike protein CDS gc mod (1-1273)(K986P_V987P_H69del_V70del_A222V_Y453F_S477N_D614G_ I692V)
  source 1..3816: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23160 - RNA, 3816 nt, synthetic construct
  misc_feature 1..3816: note = SARS-CoV-2/Wuhan/WIV05/2019__EPI_ISL_402128 spike protein CDS gc mod (1-1273)(K986P_V987P_H69del_V70del_Y453F_D614G_I692V_M1229I )
  source 1..3816: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23161 - RNA, 3813 nt, synthetic construct
  misc_feature 1..3813: note = SARS-CoV-2/Wuhan/WIV05/2019__EPI_ISL_402128 spike protein CDS gc mod (1-1273)(K986P_V987P_K986P_V987P_H69del_V70del_Y144del_N501 Y_A570D_D614G_P681H_T716I_S982A_D1118H)
  source 1..3813: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccacagacgggctagaagcgtggccagccagagcatcattgcctacacaatgtctctgggcgccgagaacagcgtggcctactccaacaactctatcgctatccccatcaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23162 - RNA, 3822 nt, synthetic construct
  misc_feature 1..3822: note = SARS-CoV-2/Wuhan/WIV05/2019__EPI_ISL_402128 spike protein CDS gc mod (1-1273)(K986P_V987P_K986P_V987P_K417N_E484K_N501Y_D614G)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23163 - RNA, 3813 nt, synthetic construct
  misc_feature 1..3813: note = SARS-CoV-2/Wuhan/WIV05/2019__EPI_ISL_402128 spike protein CDS gc mod (1-1273)(K986P_V987P_K986P_V987P_L18F_D80A_D215G_L242del_A2 43del_L244del_R246I_K417N_E484K_N501Y_D614G_A701V)
  source 1..3813: mol_type = other RNA
atgttcgtgtttctggtgctgctgcccctggtgtccagccagtgtgtgaacttcaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgtggagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23164 - RNA, 3822 nt, synthetic construct
  misc_feature 1..3822: note = SARS-CoV-2/Wuhan/WIV05/2019__EPI_ISL_402128 spike protein CDS gc mod (1-1273)(K986P_V987P_K986P_V987P_E484K_D614G)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23165 - RNA, 3822 nt, synthetic construct
  misc_feature 1..3822: note = SARS-CoV-2/Wuhan/WIV05/2019__EPI_ISL_402128 spike protein CDS gc mod (1-1273)(K986P_V987P_K986P_V987P_L18F_T20N_P26S_D138Y_R190S _K417T_E484K_N501Y_D614G_H655Y_T1027I)
  source 1..3822: mol_type = other RNA
atgttcgtgtttctggtgctgctgcccctggtgtccagccagtgtgtgaacttcaccaacagaacacagctgcctagcgcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23166 - RNA, 3822 nt, synthetic construct
  misc_feature 1..3822: note = SARS-CoV-2/Wuhan/WIV05/2019__EPI_ISL_402128 spike protein CDS gc mod (1-1273)(K986P_V987P_K986P_V987P_S13I_W152C_L452R_D614G)
  source 1..3822: mol_type = other RNA
atgttcgtgtttctggtgctgctgcccctggtgtccatccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23167 - RNA, 3822 nt, synthetic construct
  misc_feature 1..3822: note = SARS-CoV-2/Wuhan/WIV05/2019__EPI_ISL_402128 spike protein CDS gc mod (1-1273)(K986P_V987P)
  source 1..3822: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23168 - RNA, 3822 nt, synthetic construct
  misc_feature 1..3822: note = SARS-CoV-2/Wuhan/WIV05/2019__EPI_ISL_402128 spike protein CDS gc mod (1-1273)(K986P_V987P_ D614G)
  source 1..3822: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23169 - RNA, 3822 nt, synthetic construct
  misc_feature 1..3822: note = SARS-CoV-2/Wuhan/WIV05/2019__EPI_ISL_402128 spike protein CDS gc mod (1-1273)(K986P_V987P_A222V_D614G)
  source 1..3822: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23170 - RNA, 3822 nt, synthetic construct
  misc_feature 1..3822: note = SARS-CoV-2/Wuhan/WIV05/2019__EPI_ISL_402128 spike protein CDS gc mod (1-1273)(K986P_V987P_N439K_D614G)
  source 1..3822: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23171 - RNA, 3822 nt, synthetic construct
  misc_feature 1..3822: note = SARS-CoV-2/Wuhan/WIV05/2019__EPI_ISL_402128 spike protein CDS gc mod (1-1273)(K986P_V987P_S477N_D614G)
  source 1..3822: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23172 - RNA, 3822 nt, synthetic construct
  misc_feature 1..3822: note = SARS-CoV-2/Wuhan/WIV05/2019__EPI_ISL_402128 spike protein CDS gc mod (1-1273)(K986P_V987P_N501Y_D614G)
  source 1..3822: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23173 - RNA, 3816 nt, synthetic construct
  misc_feature 1..3816: note = SARS-CoV-2/Wuhan/WIV05/2019__EPI_ISL_402128 spike protein CDS gc mod (1-1273)(K986P_V987P_H69del_V70del_D614G)
  source 1..3816: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23174 - RNA, 3822 nt, synthetic construct
  misc_feature 1..3822: note = SARS-CoV-2/Wuhan/WIV05/2019__EPI_ISL_402128 spike protein CDS gc mod (1-1273)(K986P_V987P_Y453F_D614G)
  source 1..3822: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23175 - RNA, 3822 nt, synthetic construct
  misc_feature 1..3822: note = SARS-CoV-2/Wuhan/WIV05/2019__EPI_ISL_402128 spike protein CDS gc mod (1-1273)(K986P_V987P_D614G_I692V)
  source 1..3822: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23176 - RNA, 3822 nt, synthetic construct
  misc_feature 1..3822: note = SARS-CoV-2/Wuhan/WIV05/2019__EPI_ISL_402128 spike protein CDS gc mod (1-1273)(K986P_V987P_D614G_M1229I)
  source 1..3822: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23177 - RNA, 3816 nt, synthetic construct
  misc_feature 1..3816: note = SARS-CoV-2/Wuhan/WIV05/2019__EPI_ISL_402128 spike protein CDS gc mod (1-1273)(K986P_V987P_H69del_V70del_A222V_Y453F_S477N_D614G_ I692V)
  source 1..3816: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23178 - RNA, 3816 nt, synthetic construct
  misc_feature 1..3816: note = SARS-CoV-2/Wuhan/WIV05/2019__EPI_ISL_402128 spike protein CDS gc mod (1-1273)(K986P_V987P_H69del_V70del_Y453F_D614G_I692V_M1229I )
  source 1..3816: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23179 - RNA, 3813 nt, synthetic construct
  misc_feature 1..3813: note = SARS-CoV-2/Wuhan/WIV05/2019__EPI_ISL_402128 spike protein CDS gc mod (1-1273)(K986P_V987P_K986P_V987P_H69del_V70del_Y144del_N501 Y_A570D_D614G_P681H_T716I_S982A_D1118H)
  source 1..3813: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccaccggagagccagaagcgtggccagccagagcatcattgcctacacaatgtctctgggcgccgagaacagcgtggcctactccaacaactctatcgctatccccatcaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23180 - RNA, 3822 nt, synthetic construct
  misc_feature 1..3822: note = SARS-CoV-2/Wuhan/WIV05/2019__EPI_ISL_402128 spike protein CDS gc mod (1-1273)(K986P_V987P_K986P_V987P_K417N_E484K_N501Y_D614G)
  source 1..3822: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23181 - RNA, 3813 nt, synthetic construct
  misc_feature 1..3813: note = SARS-CoV-2/Wuhan/WIV05/2019__EPI_ISL_402128 spike protein CDS gc mod (1-1273)(K986P_V987P_K986P_V987P_L18F_D80A_D215G_L242del_A2 43del_L244del_R246I_K417N_E484K_N501Y_D614G_A701V)
  source 1..3813: mol_type = other RNA
atgttcgtgttcctggtgctgctgcctctggtgtccagccagtgtgtgaacttcaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgtggagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23182 - RNA, 3822 nt, synthetic construct
  misc_feature 1..3822: note = SARS-CoV-2/Wuhan/WIV05/2019__EPI_ISL_402128 spike protein CDS gc mod (1-1273)(K986P_V987P_K986P_V987P_E484K_D614G)
  source 1..3822: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23183 - RNA, 3822 nt, synthetic construct
  misc_feature 1..3822: note = SARS-CoV-2/Wuhan/WIV05/2019__EPI_ISL_402128 spike protein CDS gc mod (1-1273)(K986P_V987P_K986P_V987P_L18F_T20N_P26S_D138Y_R190S _K417T_E484K_N501Y_D614G_H655Y_T1027I)
  source 1..3822: mol_type = other RNA
atgttcgtgttcctggtgctgctgcctctggtgtccagccagtgtgtgaacttcaccaacagaacacagctgcctagcgcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23184 - RNA, 3822 nt, synthetic construct
  misc_feature 1..3822: note = SARS-CoV-2/Wuhan/WIV05/2019__EPI_ISL_402128 spike protein CDS gc mod (1-1273)(K986P_V987P_K986P_V987P_S13I_W152C_L452R_D614G)
  source 1..3822: mol_type = other RNA
atgttcgtgttcctggtgctgctgcctctggtgtccatccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23185 - RNA, 1369 nt, synthetic construct; identical to SEQ ID NO: 22814
  misc_feature 1..1369: note = SARS-CoV-2/Wuhan/WIV05/2019__EPI_ISL_402128 spike protein mRNA gc (1-15,334-528) Ferritin construct R10337
  source 1..1369: mol_type = other RNA

SEQ ID NO: 23186 - RNA, 967 nt, synthetic construct; identical to SEQ ID NO: 22815
  misc_feature 1..967: note = SARS-CoV-2/Wuhan/WIV05/2019__EPI_ISL_402128 spike protein mRNA gc (334-528) Foldon construct R9926
  source 1..967: mol_type = other RNA

SEQ ID NO: 23187 - RNA, 1345 nt, synthetic construct; identical to SEQ ID NO: 22816
  misc_feature 1..1345: note = SARS-CoV-2/Wuhan/WIV05/2019__EPI_ISL_402128 spike protein mRNA gc (1-15,334-528) LumSynth construct R10335
  source 1..1345: mol_type = other RNA

SEQ ID NO: 23188 - RNA, 1306 nt, synthetic construct; identical to SEQ ID NO: 22817
  misc_feature 1..1306: note = SARS-CoV-2/Wuhan/WIV05/2019__EPI_ISL_402128 spike protein mRNA gc (334-528) LumSynth construct R10336
  source 1..1306: mol_type = other RNA

SEQ ID NO: 23189 - RNA, 4039 nt, synthetic construct; identical to SEQ ID NO: 162
  misc_feature 1..4039: note = SARS-CoV-2/Wuhan/WIV05/2019__EPI_ISL_402128 spike protein mRNA gc (1-1273) R9514
  source 1..4039: mol_type = other RNA

SEQ ID NO: 23190 - RNA, 4039 nt, synthetic construct; identical to SEQ ID NO: 22818
  misc_feature 1..4039: note = SARS-CoV-2/Wuhan/WIV05/2019__EPI_ISL_402128 spike protein mRNA gc (1-1273)(D614G)
  source 1..4039: mol_type = other RNA

SEQ ID NO: 23191 - RNA, 4039 nt, synthetic construct; identical to SEQ ID NO: 22820
  misc_feature 1..4039: note = SARS-CoV-2/Wuhan/WIV05/2019__EPI_ISL_402128 spike protein mRNA gc (1-1273)(A222V_D614G) R10276
  source 1..4039: mol_type = other RNA

SEQ ID NO: 23192 - RNA, 4039 nt, synthetic construct; identical to SEQ ID NO: 22822
  misc_feature 1..4039: note = SARS-CoV-2/Wuhan/WIV05/2019__EPI_ISL_402128 spike protein mRNA gc (1-1273)(N439K_D614G) R10296
  source 1..4039: mol_type = other RNA

SEQ ID NO: 23193 - RNA, 4039 nt, synthetic construct; identical to SEQ ID NO: 22824
  misc_feature 1..4039: note = SARS-CoV-2/Wuhan/WIV05/2019__EPI_ISL_402128 spike protein mRNA gc (1-1273)(S477N_D614G) R10284
  source 1..4039: mol_type = other RNA

SEQ ID NO: 23194 - RNA, 4039 nt, synthetic construct; identical to SEQ ID NO: 22826
  misc_feature 1..4039: note = SARS-CoV-2/Wuhan/WIV05/2019__EPI_ISL_402128 spike protein mRNA gc (1-1273)(N501Y_D614G) R10350
  source 1..4039: mol_type = other RNA

SEQ ID NO: 23195 - RNA, 4033 nt, synthetic construct; identical to SEQ ID NO: 22828
  misc_feature 1..4033: note = SARS-CoV-2/Wuhan/WIV05/2019__EPI_ISL_402128 spike protein mRNA gc (1-1273)(H69del_V70del_D614G) R10272
  source 1..4033: mol_type = other RNA

SEQ ID NO: 23196 - RNA, 4039 nt, synthetic construct; identical to SEQ ID NO: 22830
  misc_feature 1..4039: note = SARS-CoV-2/Wuhan/WIV05/2019__EPI_ISL_402128 spike protein mRNA gc (1-1273)(Y453F_D614G) R10280
  source 1..4039: mol_type = other RNA

SEQ ID NO: 23197 - RNA, 4039 nt, synthetic construct; identical to SEQ ID NO: 22832
  misc_feature 1..4039: note = SARS-CoV-2/Wuhan/WIV05/2019__EPI_ISL_402128 spike protein mRNA gc (1-1273)(D614G_I692V) R10288
  source 1..4039: mol_type = other RNA

SEQ ID NO: 23198 - RNA, 4039 nt, synthetic construct; identical to SEQ ID NO: 22834
  misc_feature 1..4039: note = SARS-CoV-2/Wuhan/WIV05/2019__EPI_ISL_402128 spike protein mRNA gc (1-1273)(D614G_M1229I) R10344
  source 1..4039: mol_type = other RNA

SEQ ID NO: 23199 - RNA, 4033 nt, synthetic construct; identical to SEQ ID NO: 22836
  misc_feature 1..4033: note = SARS-CoV-2/Wuhan/WIV05/2019__EPI_ISL_402128 spike protein mRNA gc (1-1273)(H69del_V70del_A222V_Y453F_S477N_D614G_I692V) R10292
  source 1..4033: mol_type = other RNA

SEQ ID NO: 23200 - RNA, 4033 nt, synthetic construct; identical to SEQ ID NO: 22838
  misc_feature 1..4033: note = SARS-CoV-2/Wuhan/WIV05/2019__EPI_ISL_402128 spike protein mRNA gc (1-1273)(H69del_V70del_Y453F_D614G_I692V_M1229I) R10346
  source 1..4033: mol_type = other RNA

SEQ ID NO: 23201 - RNA, 4030 nt, synthetic construct
  misc_feature 1..4030: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H) R10352
  source 1..4030: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgacgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactcccaccggcgcgcccggagcgtggcgtcccagagcatcatcgcctacaccatgtccctgggcgccgagaacagcgtcgcctactccaacaacagcatcgccatccccatcaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctcgcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccacccacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23202 - RNA, 4039 nt, synthetic construct
  misc_feature 1..4039: note = SARS-CoV-2/Wuhan/WIV05/2019__EPI_ISL_402128 spike protein mRNA gc (1-1273)(K417N_E484K_N501Y_D614G) R10358
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23203 - RNA, 4030 nt, synthetic construct
  misc_feature 1..4030: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4030: mol_type = other RNA
aggagaaagcttaccatgttcgtgttcctggtcctcctgcccctggtgagctcccagtgcgtgaacttcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgccaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccggggcctgccccaggggttcagcgccctcgagcccctggtggacctgcccatcggcatcaacatcacccgcttccagaccctccacatctcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgtggagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23204 - RNA, 4039 nt, synthetic construct
  misc_feature 1..4039: note = SARS-CoV-2/Wuhan/WIV05/2019__EPI_ISL_402128 spike protein mRNA gc (1-1273)(E484K_D614G)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23205 - RNA, 4039 nt, synthetic construct
  misc_feature 1..4039: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4039: mol_type = other RNA
aggagaaagcttaccatgttcgtgttcctggtcctcctgcccctggtgagctcccagtgcgtgaacttcaccaaccgcacgcagctgccgagcgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaactaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctcagcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaccatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgatcaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23206 - RNA, 4039 nt, synthetic construct
  misc_feature 1..4039: note = SARS-CoV-2/Wuhan/WIV05/2019__EPI_ISL_402128 spike protein mRNA gc (1-1273)(S13I_W152C_L452R_D614G)
  source 1..4039: mol_type = other RNA
aggagaaagcttaccatgttcgtgttcctggtcctcctgcccctggtgagcatccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctgcatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactaccgctaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23207 - RNA, 4039 nt, synthetic construct; identical to SEQ ID NO: 162
  misc_feature 1..4039: note = SARS-CoV-2/Wuhan/WIV05/2019__EPI_ISL_402128 spike protein mRNA gc (1-1273) R9514
  source 1..4039: mol_type = other RNA

SEQ ID NO: 23208 - RNA, 4039 nt, synthetic construct; identical to SEQ ID NO: 12751
  misc_feature 1..4039: note = SARS-CoV-2/Wuhan/WIV05/2019__EPI_ISL_402128 spike protein mRNA gc (1-1273)(D614G)
  source 1..4039: mol_type = other RNA

SEQ ID NO: 23209 - RNA, 4039 nt, synthetic construct
  misc_feature 1..4039: note = SARS-CoV-2/Wuhan/WIV05/2019__EPI_ISL_402128 spike protein mRNA gc (1-1273)(A222V_D614G)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtgctcgagcccctggtggacctgcccatcggcatcaacatcacccgcttccagaccctcctggccctgcaccggtcctacctcacgccgggggacagcagctccggctggaccgccggcgcggccgcctactacgtcgggtacctgcagccccgcaccttcctgctcaagtacaacgagaacggcaccatcacggacgccgtggactgcgcgctggaccccctgagcgagaccaagtgcaccctcaagtccttcaccgtggagaaggggatctaccagacgagcaacttccgggtccagcccaccgagtccatcgtgcgcttcccgaacatcaccaacctgtgccccttcggcgaggtcttcaacgccacccggttcgccagcgtgtacgcctggaaccgcaagcggatctccaactgcgtggccgactacagcgtcctgtacaactccgcgagcttctccacgttcaagtgctacggcgtgagccccaccaagctcaacgacctgtgcttcaccaacgtgtacgccgactccttcgtcatccgcggggacgaggtgcggcagatcgcccccggccagaccgggaagatcgccgactacaactacaagctgccggacgacttcacgggctgcgtgatcgcctggaacagcaacaacctcgactccaaggtcgggggcaactacaactacctgtaccgcctgttccgcaagagcaacctcaagcccttcgagcgggacatctccaccgagatctaccaggcgggcagcaccccctgcaacggggtggagggcttcaactgctacttccccctgcagtcctacgggttccagccgaccaacggcgtggggtaccagccctaccgggtcgtggtgctgagcttcgagctcctgcacgcccccgccacggtctgcggccccaagaagtccaccaacctggtgaagaacaagtgcgtgaacttcaacttcaacggcctcaccgggaccggcgtcctgaccgagagcaacaagaagttcctgccgttccagcagttcgggcgcgacatcgccgacacgaccgacgccgtgcgcgacccccagaccctggagatcctcgacatcaccccctgcagcttcggcggggtgtccgtcatcacgccgggcaccaacaccagcaaccaggtggcggtgctgtaccagggcgtcaactgcaccgaggtgcccgtggccatccacgccgaccagctgacgcccacctggcgggtctactccaccgggagcaacgtgttccagacccgcgccggctgcctcatcggggccgagcacgtgaacaactcctacgagtgcgacatccccatcggcgcgggcatctgcgccagctaccagacgcagaccaactccccgcggcgcgcccggagcgtcgcctcccagagcatcatcgcgtacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgccctgacgggcatcgcggtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggccgcggagatccgcgccagcgccaacctcgccgccaccaagatgtccgagtgcgtgctgggccagagcaagcgggtggacttctgcgggaagggctaccacctgatgtccttcccccagagcgcgccgcacggggtcgtgttcctccacgtcacgtacgtgcccgcccaggagaagaacttcaccaccgcccccgccatctgccacgacggcaaggcgcacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgccatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23210 - RNA, 4039 nt, synthetic construct
  misc_feature 1..4039: note = SARS-CoV-2/Wuhan/WIV05/2019__EPI_ISL_402128 spike protein mRNA gc (1-1273)(N439K_D614G)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23211 - RNA, 4039 nt, synthetic construct
  misc_feature 1..4039: note = SARS-CoV-2/Wuhan/WIV05/2019__EPI_ISL_402128 spike protein mRNA gc (1-1273)(S477N_D614G)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgagcgtgatcacgccgggcaccaacacctccaaccaggtcgccgtgctgtaccagggcgtgaactgcaccgaggtccccgtggccatccacgccgaccagctgacgcccacctggcgggtgtacagcaccgggtccaacgtcttccagacccgcgccggctgcctcatcggggcggagcacgtgaacaacagctacgagtgcgacatccccatcggcgccggcatctgcgcctcctaccagacgcagaccaacagcccgcggcgcgcccggtccgtggcgagccagtccatcatcgcctacaccatgagcctgggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctcctgctgcagtacgggagcttctgcacccagctcaaccgcgcgctgacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacacctccgccctcctggcgggcaccatcacgagcgggtggaccttcggcgccggcgccgccctgcagatccccttcgcgatgcagatggcctaccggttcaacgggatcggcgtcacccagaacgtgctctacgagaaccagaagctgatcgccaaccagttcaactccgccatcgggaagatccaggacagcctgtccagcaccgcctccgcgctcggcaagctgcaggacgtggtcaaccagaacgcccaggccctgaacacgctcgtgaagcagctgagctccaacttcggggccatcagctccgtgctgaacgacatcctcagccgcctggacaaggtcgaggccgaggtgcagatcgaccggctgatcaccggccgcctccagtccctgcagacctacgtgacccagcagctgatccgggcggccgagatccgcgccagcgccaacctcgccgcgaccaagatgagcgagtgcgtcctgggccagtccaagcgggtggacttctgcgggaagggctaccacctgatgagcttcccccagtccgccccgcacggggtggtcttcctccacgtgacgtacgtccccgcccaggagaagaacttcaccaccgcccccgcgatctgccacgacggcaaggcccacttcccccgcgagggggtgttcgtgagcaacggcacccactggttcgtcacgcagcggaacttctacgagccgcagatcatcaccaccgacaacaccttcgtgtccggcaactgcgacgtggtcatcgggatcgtgaacaacacggtgtacgaccccctgcagcccgagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccgtggtacatctggctgggcttcatcgccgggctgatcgcgatcgtgatggtgaccatcatgctctgctgcatgacctcctgctgcagctgcctgaagggctgctgctcctgcgggagctgctgcaagttcgacgaggacgactccgagcccgtcctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23212 - RNA, 4039 nt, synthetic construct
  misc_feature 1..4039: note = SARS-CoV-2/Wuhan/WIV05/2019__EPI_ISL_402128 spike protein mRNA gc (1-1273)(N501Y_D614G)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23213 - RNA, 4033 nt, synthetic construct
  misc_feature 1..4033: note = SARS-CoV-2/Wuhan/WIV05/2019__EPI_ISL_402128 spike protein mRNA gc (1-1273)(H69del_V70del_D614G)
  source 1..4033: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtggcctactccaacaacagcatcgccatccccaccaacttcacgatctccgtcaccaccgagatcctgcccgtgagcatgaccaagacgagcgtggactgcaccatgtacatctgcggcgactccaccgagtgcagcaacctcctgctgcagtacgggtccttctgcacccagctcaaccgcgcgctgacgggcatcgccgtcgagcaggacaagaacacccaggaggtgttcgcccaggtgaagcagatctacaagacgcccccgatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtcctctacgagaaccagaagctgatcgccaaccagttcaacagcgccatcgggaagatccaggactccctgagctccaccgccagcgcgctcggcaagctgcaggacgtggtgaaccagaacgcccaggccctgaacacgctcgtcaagcagctgtccagcaacttcggggccatctccagcgtgctgaacgacatcctctcccgcctggacaaggtggaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgccccgcacggggtggtgttcctccacgtcacgtacgtgcccgcccaggagaagaacttcaccaccgcccccgcgatctgccacgacggcaaggcccacttcccccgcgagggggtcttcgtgtccaacggcacccactggttcgtgacgcagcggaacttctacgagccgcagatcatcaccaccgacaacaccttcgtcagcggcaactgcgacgtggtgatcgggatcgtcaacaacacggtgtacgaccccctgcagcccgagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagcccgtgctgaagggcgtcaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23214 - RNA, 4039 nt, synthetic construct
  misc_feature 1..4039: note = SARS-CoV-2/Wuhan/WIV05/2019__EPI_ISL_402128 spike protein mRNA gc (1-1273)(Y453F_D614G)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23215 - RNA, 4039 nt, synthetic construct
  misc_feature 1..4039: note = SARS-CoV-2/Wuhan/WIV05/2019__EPI_ISL_402128 spike protein mRNA gc (1-1273)(D614G_I692V)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcgtcatcgcctacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgcgctgacgggcatcgccgtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtcctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtgctctacgagaaccagaagctgatcgccaaccagttcaacagcgccatcgggaagatccaggactccctgagctccaccgccagcgcgctcggcaagctgcaggacgtcgtgaaccagaacgcccaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggcggccgagatccgcgccagcgccaacctcgccgcgaccaagatgtccgagtgcgtgctgggccagagcaagcgggtggacttctgcgggaagggctaccacctgatgtccttcccccagagcgccccgcacggggtcgtgttcctccacgtcacgtacgtgcccgcccaggagaagaacttcaccaccgcccccgcgatctgccacgacggcaaggcccacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgcgatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23216 - RNA, 4039 nt, synthetic construct; identical to SEQ ID NO: 12796
  misc_feature 1..4039: note = SARS-CoV-2/Wuhan/WIV05/2019__EPI_ISL_402128 spike protein mRNA gc (1-1273)(D614G_M1229I)
  source 1..4039: mol_type = other RNA

SEQ ID NO: 23217 - RNA, 4033 nt, synthetic construct
  misc_feature 1..4033: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4033: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgtcctcgagcccctggtggacctgcccatcggcatcaacatcacccgcttccagaccctcctggccctgcaccggtcctacctcacgccgggggacagcagctccggctggaccgccggcgcggccgcctactacgtggggtacctgcagccccgcaccttcctgctcaagtacaacgagaacggcaccatcacggacgccgtcgactgcgcgctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggccgactacagcgtgctgtacaactccgcgagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcctggaacagcaacaacctcgactccaaggtcgggggcaactacaactacctgttccgcctgttccgcaagagcaacctcaagcccttcgagcgggacatctccaccgagatctaccaggcgggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgccgtccgcgacccccagaccctggagatcctcgacatcaccccctgcagcttcggcggggtgagcgtgatcacgccgggcaccaacacctccaaccaggtcgcggtgctgtaccagggcgtgaactgcaccgaggtccccgtggccatccacgccgaccagctgacgcccacctggcgggtgtacagcaccgggtccaacgtcttccagacccgcgccggctgcctcatcggggccgagcacgtgaacaacagctacgagtgcgacatccccatcggcgcgggcatctgcgcctcctaccagacgcagaccaacagcccgcggcgcgcccggtccgtggccagccagtccgtcatcgcgtacaccatgagcctgggggccgagaactccgtggcctacagcaacaactccatcgccatccccaccaacttcacgatcagcgtgaccaccgagatcctgcccgtctccatgaccaagacgagcgtggactgcaccatgtacatctgcggcgacagcaccgagtgctccaacctcctgctgcagtacgggagcttctgcacccagctcaaccgcgccctgacgggcatcgcggtggagcaggacaagaacacccaggaggtcttcgcccaggtgaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacacctccgccctcctggccggcaccatcacgagcgggtggaccttcggcgcgggcgccgccctgcagatccccttcgccatgcagatggcgtaccggttcaacgggatcggcgtgacccagaacgtgctctacgagaaccagaagctgatcgccaaccagttcaactccgccatcgggaagatccaggacagcctgtccagcaccgcctccgccctcggcaagctgcaggacgtcgtgaaccagaacgcgcaggccctgaacacgctcgtgaagcagctgagctccaacttcggggccatcagctccgtcctgaacgacatcctcagccgcctggacaaggtggaggccgaggtgcagatcgaccggctgatcaccggccgcctccagtccctgcagacctacgtcacccagcagctgatccgggccgcggagatccgcgccagcgccaacctcgccgccaccaagatgagcgagtgcgtgctgggccagtccaagcgggtggacttctgcgggaagggctaccacctgatgagcttcccccagtccgcgccgcacggggtcgtgttcctccacgtcacgtacgtgcccgcccaggagaagaacttcaccaccgcccccgccatctgccacgacggcaaggcgcacttcccccgcgagggggtgttcgtcagcaacggcacccactggttcgtgacgcagcggaacttctacgagccgcagatcatcaccaccgacaacaccttcgtgtccggcaactgcgacgtcgtgatcgggatcgtgaacaacacggtctacgaccccctgcagcccgagctggacagcttcaaggaggagctcgacaagtacttcaagaaccacacctcccccgacgtggacctgggcgacatcagcgggatcaacgcctccgtggtcaacatccagaaggagatcgaccgcctgaacgaggtggccaagaacctcaacgagagcctgatcgacctgcaggagctcggcaagtacgagcagtacatcaagtggccgtggtacatctggctgggcttcatcgccgggctgatcgccatcgtgatggtcaccatcatgctctgctgcatgacctcctgctgcagctgcctgaagggctgctgctcctgcgggagctgctgcaagttcgacgaggacgactccgagcccgtgctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23218 - RNA, 4033 nt, synthetic construct
  misc_feature 1..4033: note = SARS-CoV-2/Wuhan/WIV05/2019__EPI_ISL_402128 spike protein mRNA gc (1-1273)(H69del_V70del_Y453F_D614G_I692V_M1229I)
  source 1..4033: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcgtgatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatcgtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23219 - RNA, 4030 nt, synthetic construct
  misc_feature 1..4030: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4030: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgacgacacgaccgacgccgtgcgcgacccccagaccctggagatcctcgacatcaccccctgcagcttcggcggggtctccgtgatcacgccgggcaccaacaccagcaaccaggtggcggtcctgtaccagggcgtgaactgcaccgaggtgcccgtcgccatccacgccgaccagctgacgcccacctggcgggtgtactccaccgggagcaacgtgttccagacccgcgccggctgcctcatcggggccgagcacgtcaacaactcctacgagtgcgacatccccatcggcgcgggcatctgcgccagctaccagacgcagaccaactcccaccggcgcgcccggagcgtggcctcccagagcatcatcgcgtacaccatgtccctgggggccgagaacagcgtggcctactccaacaacagcatcgccatcccgatcaacttcaccatctccgtcacgaccgagatcctgcccgtgagcatgaccaagaccagcgtggactgcacgatgtacatctgcggcgactccaccgagtgcagcaacctcctgctgcagtacgggtccttctgcacccagctcaaccgcgccctgaccggcatcgcggtcgagcaggacaagaacacgcaggaggtgttcgcccaggtgaagcagatctacaagaccccgcccatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgccgcgcgcgacctgatctgcgcccagaagttcaacgggctgaccgtgctgcccccgctcctgacggacgagatgatcgcccagtacaccagcgccctcctggccggcaccatcacctccgggtggacgttcggcgcgggcgccgccctgcagatccccttcgccatgcagatggcgtaccggttcaacgggatcggcgtgacccagaacgtcctctacgagaaccagaagctgatcgccaaccagttcaacagcgccatcgggaagatccaggactccctgagctccaccgccagcgccctcggcaagctgcaggacgtggtgaaccagaacgcgcaggccctgaacaccctcgtcaagcagctgtccagcaacttcggggccatctccagcgtgctgaacgacatcctcgcccgcctggacaaggtggaggccgaggtccagatcgaccggctgatcacgggccgcctccagtccctgcagacctacgtgacccagcagctgatccgggcggccgagatccgcgccagcgccaacctcgccgcgaccaagatgagcgagtgcgtgctgggccagtccaagcgggtcgacttctgcgggaagggctaccacctgatgagcttcccccagtccgcgccccacggggtggtgttcctccacgtcacctacgtgccggcccaggagaagaacttcacgaccgcccccgccatctgccacgacggcaaggcccacttcccccgcgagggggtcttcgtgagcaacggcacccactggttcgtgacccagcggaacttctacgagccccagatcatcacgacccacaacaccttcgtctccggcaactgcgacgtggtgatcgggatcgtcaacaacaccgtgtacgacccgctgcagcccgagctggacagcttcaaggaggagctcgacaagtacttcaagaaccacacgtcccccgacgtggacctgggcgacatcagcgggatcaacgcctccgtcgtgaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtcatggtgaccatcatgctctgctgcatgacctcctgctgcagctgcctgaagggctgctgctcctgcgggagctgctgcaagttcgacgaggacgactccgagccggtgctgaagggcgtcaagctccactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23220 - RNA, 4039 nt, synthetic construct
  misc_feature 1..4039: note = SARS-CoV-2/Wuhan/WIV05/2019__EPI_ISL_402128 spike protein mRNA gc (1-1273)(K417N_E484K_N501Y_D614G)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23221 - RNA, 4030 nt, synthetic construct
  misc_feature 1..4030: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4030: mol_type = other RNA
aggagaaagcttaccatgttcgtgttcctggtcctcctgcccctggtgagctcccagtgcgtgaacttcaccacccgcacgcagctcccgcccgcctacaccaacagcttcacccggggcgtctactaccccgacaaggtgttccgctccagcgtgctgcactccacccaggacctgttcctccccttcttcagcaacgtcacgtggttccacgccatccacgtgtccgggaccaacggcaccaagcggttcgcgaacccggtgctgcccttcaacgacggggtctacttcgccagcaccgagaagtccaacatcatccgcggctggatcttcgggacgaccctggacagcaagacccagtccctcctgatcgtgaacaacgccaccaacgtggtcatcaaggtgtgcgagttccagttctgcaacgaccccttcctgggcgtgtactaccacaagaacaacaagagctggatggagtccgagttccgggtctacagctccgccaacaactgcacgttcgagtacgtgagccagcccttcctcatggacctggagggcaagcaggggaacttcaagaacctgcgcgagttcgtgttcaagaacatcgacggctacttcaagatctactccaagcacaccccgatcaacctcgtccgggggctgccccagggcttcagcgccctggagcccctcgtggacctgcccatcgggatcaacatcacccgcttccagaccctgcacatctcctacctcacgccgggcgacagcagctccggctggaccgcgggggccgccgcctactacgtgggctacctgcagccccggaccttcctgctcaagtacaacgagaacgggaccatcacggacgcggtcgactgcgccctggaccccctgagcgagaccaagtgcaccctcaagtccttcaccgtggagaagggcatctaccagacgagcaacttccgcgtgcagcccaccgagtccatcgtccggttcccgaacatcaccaacctgtgccccttcggcgaggtgttcaacgccacccgcttcgccagcgtctacgcctggaaccggaagcgcatctccaactgcgtggcggactacagcgtgctgtacaactccgccagcttctccacgttcaagtgctacggggtcagccccaccaagctcaacgacctgtgcttcaccaacgtgtacgccgactccttcgtgatccggggcgacgaggtccgccagatcgcccccgggcagaccggcaacatcgccgactacaactacaagctgccggacgacttcacggggtgcgtgatcgcgtggaacagcaacaacctcgactccaaggtgggcggcaactacaactacctgtaccggctgttccgcaagagcaacctcaagcccttcgagcgggacatctccaccgagatctaccaggccgggagcaccccctgcaacggcgtcaaggggttcaactgctacttccccctgcagtcctacggcttccagccgacctacggggtgggctaccagccctaccgcgtggtcgtgctgagcttcgagctcctgcacgcccccgccacggtgtgcggccccaagaagtccaccaacctggtcaagaacaagtgcgtgaacttcaacttcaacgggctcaccggcaccggggtgctgaccgagagcaacaagaagttcctgccgttccagcagttcggccgggacatcgccgacacgaccgacgcggtccgcgacccccagaccctcgagatcctggacatcaccccctgcagcttcgggggcgtgtccgtgatcacgccgggcaccaacaccagcaaccaggtcgccgtgctgtaccagggggtgaactgcaccgaggtccccgtggccatccacgccgaccagctgacgcccacctggcgcgtgtactccaccggcagcaacgtcttccagacccgggccgggtgcctcatcggcgcggagcacgtgaacaactcctacgagtgcgacatccccatcggcgccgggatctgcgccagctaccagacgcagaccaactccccgcgccgggcccgcagcgtggcgtcccagagcatcatcgcctacaccatgtccctgggcgtcgagaacagcgtggcctactccaacaacagcatcgccatccccaccaacttcacgatctccgtgaccaccgagatcctgcccgtcagcatgaccaagacgagcgtggactgcaccatgtacatctgcggggactccaccgagtgcagcaacctcctgctgcagtacggctccttctgcacccagctcaaccgggccctgacggggatcgcggtggagcaggacaagaacacccaggaggtcttcgcccaggtgaagcagatctacaagacgcccccgatcaaggacttcggcggcttcaacttcagccagatcctgcccgacccctccaagcccagcaagcgctccttcatcgaggacctcctgttcaacaaggtgaccctggccgacgccgggttcatcaagcagtacggcgactgcctcggggacatcgccgcgcgggacctgatctgcgcccagaagttcaacggcctgaccgtcctcccgcccctgctgaccgacgagatgatcgcccagtacaccagcgccctcctggccgggaccatcacgtccggctggaccttcggcgcgggggccgccctgcagatccccttcgccatgcagatggcgtaccgcttcaacggcatcggggtgacccagaacgtgctctacgagaaccagaagctgatcgccaaccagttcaacagcgccatcggcaagatccaggactccctgagctccaccgccagcgccctcgggaagctgcaggacgtcgtgaaccagaacgcgcaggccctgaacacgctcgtgaagcagctgtccagcaacttcggcgccatctccagcgtcctgaacgacatcctctcccggctggacaaggtggaggccgaggtgcagatcgaccgcctgatcaccggccggctccagagcctgcagacctacgtcacccagcagctgatccgcgccgcggagatccgggccagcgccaacctcgccgccaccaagatgtccgagtgcgtgctggggcagagcaagcgcgtggacttctgcggcaaggggtaccacctgatgtccttcccccagagcgcgccgcacggcgtcgtgttcctccacgtcacgtacgtgcccgcccaggagaagaacttcaccaccgcccccgccatctgccacgacgggaaggcgcacttcccccgggagggcgtgttcgtctccaacggcacccactggttcgtgacgcagcgcaacttctacgagccgcagatcatcaccaccgacaacaccttcgtgagcgggaactgcgacgtcgtgatcggcatcgtgaacaacacggtctacgaccccctgcagcccgagctggactccttcaaggaggagctcgacaagtacttcaagaaccacaccagccccgacgtggacctgggggacatctccggcatcaacgccagcgtggtcaacatccagaaggagatcgaccggctgaacgaggtggccaagaacctcaacgagtccctgatcgacctgcaggagctcggcaagtacgagcagtacatcaagtggccgtggtacatctggctggggttcatcgccggcctgatcgccatcgtgatggtcaccatcatgctctgctgcatgaccagctgctgctcctgcctgaaggggtgctgcagctgcggctcctgctgcaagttcgacgaggacgacagcgagcccgtgctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23222 - RNA, 4039 nt, synthetic construct
  misc_feature 1..4039: note = SARS-CoV-2/Wuhan/WIV05/2019__EPI_ISL_402128 spike protein mRNA gc (1-1273)(E484K_D614G)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23223 - RNA, 4039 nt, synthetic construct
  misc_feature 1..4039: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4039: mol_type = other RNA
aggagaaagcttaccatgttcgtgttcctggtcctcctgcccctggtgagctcccagtgcgtgaacttcaccaaccgcacccagctcccgagcgcctacacgaactccttcacccggggcgtctactaccccgacaaggtgttccgcagctccgtgctgcacagcacccaggacctgttcctccccttcttctccaacgtcacctggttccacgccatccacgtgagcgggacgaacggcaccaagcggttcgacaaccccgtgctgccgttcaacgacggggtctacttcgcgtccaccgagaagtccaacatcatccgcggctggatcttcgggaccacgctggactccaagacccagagcctcctgatcgtgaacaacgccaccaacgtggtcatcaaggtgtgcgagttccagttctgcaactaccccttcctgggcgtgtactaccacaagaacaacaagtcctggatggagagcgagttccgggtctactccagcgccaacaactgcaccttcgagtacgtgtcccagcccttcctcatggacctggagggcaagcaggggaacttcaagaacctgagcgagttcgtgttcaagaacatcgacggctacttcaagatctactccaagcacacgcccatcaacctcgtccgcgacctgccgcaggggttcagcgccctggagcccctcgtggacctgcccatcggcatcaacatcacccggttccagaccctgctcgccctgcaccgcagctacctgacccccggggactccagctccggctggacggcgggcgccgccgcctactacgtggggtacctccagccgcggaccttcctgctgaagtacaacgagaacggcaccatcaccgacgcggtcgactgcgccctcgaccccctgagcgagacgaagtgcaccctgaagtccttcaccgtggagaaggggatctaccagaccagcaacttccgcgtgcagcccacggagtccatcgtccggttccccaacatcaccaacctctgcccgttcggcgaggtgttcaacgccacccgcttcgccagcgtctacgcctggaaccggaagcgcatctccaactgcgtggcggactacagcgtgctgtacaactccgccagcttctccaccttcaagtgctacggcgtcagccccacgaagctgaacgacctctgcttcaccaacgtgtacgccgactccttcgtgatccgcggggacgaggtccggcagatcgcccccggccagaccgggaccatcgccgactacaactacaagctgcccgacgacttcacgggctgcgtgatcgcgtggaacagcaacaacctggactccaaggtcgggggcaactacaactacctctaccggctgttccgcaagagcaacctgaagccgttcgagcgggacatctccaccgagatctaccaggccggcagcaccccctgcaacggggtgaagggcttcaactgctacttccccctccagagctacgggttccagcccacctacggcgtggggtaccagccgtaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgcccttccagcagttcgggcgggacatcgccgacacgaccgacgcggtccgcgacccgcagaccctggagatcctggacatcaccccctgcagcttcggcggggtgtccgtgatcacgcccggcaccaacaccagcaaccaggtcgccgtgctctaccagggcgtgaactgcaccgaggtcccggtggccatccacgccgaccagctgacgcccacctggcgcgtgtactccaccgggagcaacgtcttccagacccgggccggctgcctgatcggggcggagtacgtgaacaactcctacgagtgcgacatccccatcggcgccggcatctgcgccagctaccagacgcagaccaacagcccccgccgggcccgcagcgtggcgtcccagagcatcatcgcctacaccatgtccctcggggccgagaacagcgtcgcctactccaacaacagcatcgccatcccgaccaacttcacgatcagcgtgaccaccgagatcctgcccgtgtccatgaccaagacgagcgtcgactgcaccatgtacatctgcggcgactccaccgagtgcagcaacctgctcctgcagtacgggtccttctgcacccagctgaaccgggcgctcacgggcatcgccgtggagcaggacaagaacacccaggaggtgttcgcccaggtcaagcagatctacaagaccccgcccatcaaggacttcgggggcttcaacttcagccagatcctgcccgacccctccaagcccagcaagcgctccttcatcgaggacctcctgttcaacaaggtgaccctggccgacgccggcttcatcaagcagtacggggactgcctgggcgacatcgcggcccgggacctcatctgcgcccagaagttcaacgggctgacggtgctgcccccgctcctgaccgacgagatgatcgcccagtacaccagcgccctgctcgcgggcaccatcacgtccgggtggaccttcggcgccggcgccgccctgcagatccccttcgcgatgcagatggcctaccgcttcaacgggatcggcgtcacccagaacgtgctgtacgagaaccagaagctcatcgccaaccagttcaacagcgccatcgggaagatccaggactccctgagctccaccgccagcgcgctgggcaagctccaggacgtggtcaaccagaacgcccaggccctgaacacgctggtgaagcagctctccagcaacttcggggccatctccagcgtgctgaacgacatcctgagccggctcgacaaggtcgaggccgaggtgcagatcgaccgcctgatcaccggccggctgcagtccctccagacctacgtgacccagcagctgatccgcgcggccgagatccgggccagcgccaacctggccgcgatcaagatgtccgagtgcgtcctcggccagagcaagcgcgtggacttctgcgggaagggctaccacctgatgtccttcccccagagcgcgccccacggggtggtcttcctgcacgtgacctacgtcccggcccaggagaagaacttcacgaccgcccccgccatctgccacgacggcaaggcccacttcccccgggagggggtgttcgtgtccaacggcacccactggttcgtcacccagcgcaacttctacgagccccagatcatcacgaccgacaacaccttcgtgagcggcaactgcgacgtggtcatcgggatcgtgaacaacaccgtgtacgacccgctccagcccgagctggactccttcaaggaggagctggacaagtacttcaagaaccacacgagccccgacgtcgacctcggcgacatctccgggatcaacgccagcgtggtgaacatccagaaggagatcgaccggctgaacgaggtcgccaagaacctgaacgagtccctcatcgacctgcaggagctgggcaagtacgagcagtacatcaagtggccctggtacatctggctcggcttcatcgccgggctgatcgcgatcgtgatggtgaccatcatgctgtgctgcatgaccagctgctgctcctgcctcaagggctgctgcagctgcgggtcctgctgcaagttcgacgaggacgacagcgagccggtcctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23224 - RNA, 4039 nt, synthetic construct
  misc_feature 1..4039: note = SARS-CoV-2/Wuhan/WIV05/2019__EPI_ISL_402128 spike protein mRNA gc (1-1273)(S13I_W152C_L452R_D614G)
  source 1..4039: mol_type = other RNA
aggagaaagcttaccatgttcgtgttcctggtcctcctgcccctggtgagcatccagtgcgtgaacctcaccacccgcacgcagctgccgcccgcctacaccaactccttcacccggggcgtctactaccccgacaaggtgttccgcagctccgtgctgcacagcacccaggacctcttcctgcccttcttctccaacgtcacgtggttccacgccatccacgtgagcgggaccaacggcaccaagcggttcgacaacccggtgctgcccttcaacgacggggtctacttcgcgtccaccgagaagtccaacatcatccgcggctggatcttcgggacgaccctcgacagcaagacccagagcctgctgatcgtgaacaacgccaccaacgtggtcatcaaggtgtgcgagttccagttctgcaacgaccccttcctcggcgtgtactaccacaagaacaacaagtcctgcatggagagcgagttccgggtctactccagcgccaacaactgcacgttcgagtacgtgtcccagcccttcctgatggacctggagggcaagcaggggaacttcaagaacctccgcgagttcgtgttcaagaacatcgacggctacttcaagatctacagcaagcacaccccgatcaacctggtccgggacctgccccaggggttctccgccctcgagcccctggtggacctgcccatcggcatcaacatcacccgcttccagaccctcctggccctgcaccggagctacctcacgccgggggactccagcagcggctggaccgcgggcgccgccgcctactacgtggggtacctgcagccccgcaccttcctgctcaagtacaacgagaacggcaccatcacggacgcggtcgactgcgccctggaccccctgtccgagaccaagtgcaccctcaagagcttcaccgtggagaaggggatctaccagacgtccaacttccgggtgcagcccaccgagagcatcgtccgcttcccgaacatcaccaacctgtgccccttcggcgaggtgttcaacgccacccggttcgcctccgtctacgcctggaaccgcaagcggatcagcaactgcgtggcggactactccgtgctgtacaacagcgcctccttcagcacgttcaagtgctacggcgtctcccccaccaagctcaacgacctgtgcttcaccaacgtgtacgccgacagcttcgtgatccgcggggacgaggtccggcagatcgcccccggccagaccgggaagatcgccgactacaactacaagctgccggacgacttcacgggctgcgtgatcgcgtggaactccaacaacctcgacagcaaggtcgggggcaactacaactaccgctaccggctgttccgcaagtccaacctgaagcccttcgagcgggacatcagcaccgagatctaccaggccggctccaccccctgcaacggggtggagggcttcaactgctacttccccctccagagctacgggttccagccgaccaacggcgtggggtaccagccctaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgccgttccagcagttcgggcgcgacatcgccgacacgaccgacgcggtccgggacccccagaccctggagatcctggacatcaccccctgcagcttcggcggggtgagcgtgatcacgccgggcaccaacacctccaaccaggtcgccgtgctctaccagggcgtgaactgcaccgaggtccccgtggccatccacgccgaccagctgacgcccacctggcgcgtgtacagcaccgggtccaacgtcttccagacccgggccggctgcctgatcggggcggagcacgtgaacaacagctacgagtgcgacatccccatcggcgccggcatctgcgcctcctaccagacgcagaccaacagcccgcgccgggcccgctccgtggcgagccagtccatcatcgcctacaccatgagcctcggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctgctcctgcagtacgggagcttctgcacccagctgaaccgggcgctcacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcgcagcttcatcgaggacctcctgttcaacaaggtgaccctggccgacgccggcttcatcaagcagtacggggactgcctgggcgacatcgcggcccgggacctcatctgcgcccagaagttcaacgggctgaccgtgctgccgcccctcctgaccgacgagatgatcgcccagtacacctccgccctgctcgcgggcaccatcacgagcgggtggaccttcggcgccggcgccgccctgcagatccccttcgcgatgcagatggcctaccgcttcaacgggatcggcgtcacccagaacgtgctgtacgagaaccagaagctcatcgccaaccagttcaactccgccatcgggaagatccaggacagcctgtccagcaccgcctccgcgctgggcaagctccaggacgtggtcaaccagaacgcccaggccctgaacacgctggtgaagcagctcagctccaacttcggggccatcagctccgtgctgaacgacatcctgagccggctcgacaaggtcgaggccgaggtgcagatcgaccgcctgatcaccggccggctgcagtccctccagacctacgtgacccagcagctgatccgcgcggccgagatccgggccagcgccaacctggccgcgaccaagatgagcgagtgcgtcctcggccagtccaagcgcgtggacttctgcgggaagggctaccacctgatgagcttcccccagtccgccccgcacggggtggtcttcctgcacgtgacgtacgtccccgcccaggagaagaacttcaccaccgcccccgcgatctgccacgacggcaaggcccacttcccccgggagggggtgttcgtgagcaacggcacccactggttcgtcacgcagcgcaacttctacgagccgcagatcatcaccaccgacaacaccttcgtgtccggcaactgcgacgtggtcatcgggatcgtgaacaacacggtgtacgaccccctccagcccgagctggacagcttcaaggaggagctggacaagtacttcaagaaccacacctcccccgacgtcgacctcggcgacatcagcgggatcaacgcctccgtggtgaacatccagaaggagatcgaccggctgaacgaggtcgccaagaacctgaacgagagcctcatcgacctgcaggagctgggcaagtacgagcagtacatcaagtggccgtggtacatctggctcggcttcatcgccgggctgatcgcgatcgtgatggtgaccatcatgctgtgctgcatgacctcctgctgcagctgcctcaagggctgctgctcctgcgggagctgctgcaagttcgacgaggacgactccgagcccgtcctgaagggcgtgaagctgcactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23225 - RNA, 4039 nt, synthetic construct
  misc_feature 1..4039: note = SARS-CoV-2/Wuhan/WIV05/2019__EPI_ISL_402128 spike protein mRNA gc (1-1273)
  source 1..4039: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccaggacgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23226 - RNA, 4039 nt, synthetic construct
  misc_feature 1..4039: note = SARS-CoV-2/Wuhan/WIV05/2019__EPI_ISL_402128 spike protein mRNA gc (1-1273)(D614G)
  source 1..4039: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23227 - RNA, 4039 nt, synthetic construct
  misc_feature 1..4039: note = SARS-CoV-2/Wuhan/WIV05/2019__EPI_ISL_402128 spike protein mRNA gc (1-1273)(A222V_D614G)
  source 1..4039: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23228 - RNA, 4039 nt, synthetic construct
  misc_feature 1..4039: note = SARS-CoV-2/Wuhan/WIV05/2019__EPI_ISL_402128 spike protein mRNA gc (1-1273)(N439K_D614G)
  source 1..4039: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaagaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23229 - RNA, 4039 nt, synthetic construct
  misc_feature 1..4039: note = SARS-CoV-2/Wuhan/WIV05/2019__EPI_ISL_402128 spike protein mRNA gc (1-1273)(S477N_D614G)
  source 1..4039: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23230 - RNA, 4039 nt, synthetic construct
  misc_feature 1..4039: note = SARS-CoV-2/Wuhan/WIV05/2019__EPI_ISL_402128 spike protein mRNA gc (1-1273)(N501Y_D614G)
  source 1..4039: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23231 - RNA, 4033 nt, synthetic construct
  misc_feature 1..4033: note = SARS-CoV-2/Wuhan/WIV05/2019__EPI_ISL_402128 spike protein mRNA gc (1-1273)(H69del_V70del_D614G)
  source 1..4033: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23232 - RNA, 4039 nt, synthetic construct
  misc_feature 1..4039: note = SARS-CoV-2/Wuhan/WIV05/2019__EPI_ISL_402128 spike protein mRNA gc (1-1273)(Y453F_D614G)
  source 1..4039: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23233 - RNA, 4039 nt, synthetic construct
  misc_feature 1..4039: note = SARS-CoV-2/Wuhan/WIV05/2019__EPI_ISL_402128 spike protein mRNA gc (1-1273)(D614G_I692V)
  source 1..4039: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23234 - RNA, 4039 nt, synthetic construct
  misc_feature 1..4039: note = SARS-CoV-2/Wuhan/WIV05/2019__EPI_ISL_402128 spike protein mRNA gc (1-1273)(D614G_M1229I)
  source 1..4039: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23235 - RNA, 4033 nt, synthetic construct
  misc_feature 1..4033: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4033: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23236 - RNA, 4033 nt, synthetic construct
  misc_feature 1..4033: note = SARS-CoV-2/Wuhan/WIV05/2019__EPI_ISL_402128 spike protein mRNA gc (1-1273)(H69del_V70del_Y453F_D614G_I692V_M1229I)
  source 1..4033: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23237 - RNA, 4030 nt, synthetic construct
  misc_feature 1..4030: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4030: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgacgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcacaccggagggcaaggagcgtggccagccagagcatcatcgcctacaccatgagcctgggcgccgagaacagcgtggcctacagcaacaacagcatcgccatccccatcaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctggcccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23238 - RNA, 4039 nt, synthetic construct
  misc_feature 1..4039: note = SARS-CoV-2/Wuhan/WIV05/2019__EPI_ISL_402128 spike protein mRNA gc (1-1273)(K417N_E484K_N501Y_D614G)
  source 1..4039: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23239 - RNA, 4030 nt, synthetic construct
  misc_feature 1..4030: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4030: mol_type = other RNA
aggagaaagcttaccatgttcgtgttcctggtgctgctgcccctggtgagcagccagtgcgtgaacttcaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgccaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcggggcctgccccagggcttctcagccctggagcccctggtggacctgcccatcggcatcaacatcacccggttccagaccctgcacatcagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgtggagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23240 - RNA, 4039 nt, synthetic construct
  misc_feature 1..4039: note = SARS-CoV-2/Wuhan/WIV05/2019__EPI_ISL_402128 spike protein mRNA gc (1-1273)(E484K_D614G)
  source 1..4039: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23241 - RNA, 4039 nt, synthetic construct
  misc_feature 1..4039: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4039: mol_type = other RNA
aggagaaagcttaccatgttcgtgttcctggtgctgctgcccctggtgagcagccagtgcgtgaacttcaccaaccggacccagctgccaagcgcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaactaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgagcgagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaccatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagtacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccatcaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23242 - RNA, 4039 nt, synthetic construct
  misc_feature 1..4039: note = SARS-CoV-2/Wuhan/WIV05/2019__EPI_ISL_402128 spike protein mRNA gc (1-1273)(S13I_W152C_L452R_D614G)
  source 1..4039: mol_type = other RNA
aggagaaagcttaccatgttcgtgttcctggtgctgctgcccctggtgagcatccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctgcatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactaccgctaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23243 - RNA, 4039 nt, synthetic construct
  misc_feature 1..4039: note = SARS-CoV-2/Wuhan/WIV05/2019__EPI_ISL_402128 spike protein mRNA gc (1-1273)
  source 1..4039: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccaggacgtgaactgcaccgaggtgcccgtggccatccacgccgaccagctgacccccacctggcgggtgtacagcaccggaagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgattgcctgggcgacatcgccgctcgggacctgatctgcgcccagaagttcaacgggctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggcgtgttcgtgagcaacggaacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgatgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23244 - RNA, 4039 nt, synthetic construct
  misc_feature 1..4039: note = SARS-CoV-2/Wuhan/WIV05/2019__EPI_ISL_402128 spike protein mRNA gc (1-1273)(D614G)
  source 1..4039: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23245 - RNA, 4039 nt, synthetic construct
  misc_feature 1..4039: note = SARS-CoV-2/Wuhan/WIV05/2019__EPI_ISL_402128 spike protein mRNA gc (1-1273)(A222V_D614G)
  source 1..4039: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtcagcgtgatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagcccccggcgggcccggagcgtggccagccagagcatcatcgcctacaccatgagcttaggcgccgagaacagcgtggcctacagcaacaacagcatcgccatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttttgcggcaagggctaccacctgatgagcttcccccagagcgccccacacggcgtggtcttcctccacgtgacatacgtgcccgcccaggagaagaacttcaccaccgcccccgccatttgccacgacggcaaggcccacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgctagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23246 - RNA, 4039 nt, synthetic construct
  misc_feature 1..4039: note = SARS-CoV-2/Wuhan/WIV05/2019__EPI_ISL_402128 spike protein mRNA gc (1-1273)(N439K_D614G)
  source 1..4039: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaagaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggacaaggtggaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23247 - RNA, 4039 nt, synthetic construct
  misc_feature 1..4039: note = SARS-CoV-2/Wuhan/WIV05/2019__EPI_ISL_402128 spike protein mRNA gc (1-1273)(S477N_D614G)
  source 1..4039: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcaacaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgcgcctcctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaatttcggcgccatcagcagcgtgctgaacgacatcctgtcaaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23248 - RNA, 4039 nt, synthetic construct
  misc_feature 1..4039: note = SARS-CoV-2/Wuhan/WIV05/2019__EPI_ISL_402128 spike protein mRNA gc (1-1273)(N501Y_D614G)
  source 1..4039: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggacaaggtggaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23249 - RNA, 4033 nt, synthetic construct
  misc_feature 1..4033: note = SARS-CoV-2/Wuhan/WIV05/2019__EPI_ISL_402128 spike protein mRNA gc (1-1273)(H69del_V70del_D614G)
  source 1..4033: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtgacatacgtccccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23250 - RNA, 4039 nt, synthetic construct
  misc_feature 1..4039: note = SARS-CoV-2/Wuhan/WIV05/2019__EPI_ISL_402128 spike protein mRNA gc (1-1273)(Y453F_D614G)
  source 1..4039: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23251 - RNA, 4039 nt, synthetic construct
  misc_feature 1..4039: note = SARS-CoV-2/Wuhan/WIV05/2019__EPI_ISL_402128 spike protein mRNA gc (1-1273)(D614G_I692V)
  source 1..4039: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtcttcctccacgtgacatacgtgcccgcccaggagaagaacttcaccaccgcccccgccatctgccacgacggcaaggctcacttcccccgggagggagtgttcgtgagcaacggcacccactggttcgtgacccagcggaacttctacgagccccagattatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23252 - RNA, 4039 nt, synthetic construct
  misc_feature 1..4039: note = SARS-CoV-2/Wuhan/WIV05/2019__EPI_ISL_402128 spike protein mRNA gc (1-1273)(D614G_M1229I)
  source 1..4039: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23253 - RNA, 4033 nt, synthetic construct
  misc_feature 1..4033: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4033: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcaacaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtgagcgtcatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgccggcatctgcgcttcctaccagacccagaccaacagcccccggcgggcccggagcgtggccagccagagcgtgatcgcctacaccatgagcttaggcgccgagaacagcgtggcctacagcaacaacagcatcgccatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaattttggcgccatcagcagcgtgctgaacgacatcctgtcaaggctggacaaggtggaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttctgcggcaagggctaccacctgatgagcttcccccagagcgccccacacggcgtggtcttcctccacgtgacatacgtgcccgcccaggagaagaacttcaccaccgcccccgccatctgccacgacggcaaggcccacttcccccgggagggagtgttcgtgagcaacggcacccactggttcgtgacccagcggaacttctacgagccccagattatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgctagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23254 - RNA, 4033 nt, synthetic construct
  misc_feature 1..4033: note = SARS-CoV-2/Wuhan/WIV05/2019__EPI_ISL_402128 spike protein mRNA gc (1-1273)(H69del_V70del_Y453F_D614G_I692V_M1229I)
  source 1..4033: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgccccacacggcgtggtgttcctccacgtcacatacgtgcccgcccaggagaagaacttcaccaccgcccccgccatctgccacgacggcaaggctcacttcccccgggagggagtgttcgtgagcaacggcacccactggttcgtgacccagcggaacttctacgagccccagattatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23255 - RNA, 4030 nt, synthetic construct
  misc_feature 1..4030: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4030: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgacgacaccaccgacgccgtgcgggacccccagaccctggagatcctggacatcaccccatgcagcttcggcggcgtgagcgtgatcacccccggcacaaacaccagcaaccaggtcgcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagccaccggcgggcccggagcgtggccagccagagcatcatcgcctacaccatgagcttaggcgccgagaacagcgtggcctacagcaacaacagcatcgccatccccatcaacttcaccataagcgtgaccaccgagatcctgcctgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagaccccacccatcaaggacttcggcggcttcaacttcagccagatcctgcccgaccccagcaagcccagcaagcggagcttcatcgaggacctgctgttcaacaaggtgactctggccgacgccggcttcatcaagcagtacggcgattgcctgggggacatcgccgcccgggacctgatctgcgctcagaagttcaacggcctgaccgtgctgcctcccctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaacgacatcctggccaggctggacaaggtggaggccgaggtgcagatcgaccggctgatcaccggccggctgcagagcctgcagacctacgtgacccagcagctgatccgggccgccgagattcgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacctacgtcccagcccaggagaagaacttcacaaccgcccccgccatctgccacgacggcaaggcccacttcccccgggagggagtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgaccccctgcagcccgagctggacagcttcaaggaggagctggacaagtacttcaagaaccacaccagccctgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23256 - RNA, 4039 nt, synthetic construct
  misc_feature 1..4039: note = SARS-CoV-2/Wuhan/WIV05/2019__EPI_ISL_402128 spike protein mRNA gc (1-1273)(K417N_E484K_N501Y_D614G)
  source 1..4039: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23257 - RNA, 4030 nt, synthetic construct
  misc_feature 1..4030: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4030: mol_type = other RNA
aggagaaagcttaccatgttcgtgttcctggtgctgctgcccctggtgagcagccagtgcgtgaacttcaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgccaacccagtgctgcccttcaacgacggcgtgtacttcgccagcaccgagaagtcaaacatcatccggggctggatctttggcaccaccctggacagcaagacacagagcctgctgatcgtgaacaacgctaccaacgtggtgatcaaggtgtgcgagttccagttctgcaacgaccccttcctgggcgtgtactaccacaagaacaacaagagctggatggagagcgagttccgggtctacagcagcgccaacaattgcaccttcgagtacgtgagccagcccttcctgatggacctggagggcaagcagggcaacttcaagaacctccgggagttcgtgttcaagaacatcgacggctacttcaagatctacagcaagcacacccccatcaacctggtgcggggactgccccagggcttcagcgccctggagcctctggtggatctgcccatcggcatcaacatcaccaggttccagaccctgcacatcagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcacccttaagagcttcaccgtggagaagggcatctaccagaccagcaacttccgggtgcagcccactgagagcattgtgcggttccccaacatcaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctattccgtaagagcaacctgaagccatttgagcgggacatcagcaccgagatctaccaggccggtagcaccccctgcaacggcgtgaagggcttcaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggacatcgccgacaccaccgatgcagtgcgggacccccagaccctggagatcctggacatcaccccatgcagcttcggcggcgtgagcgtcatcacccccggaacaaacaccagcaaccaggtggccgtgctgtaccagggcgtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcctgggcgtggagaacagcgtggcctacagcaacaacagcatcgccatccctaccaacttcaccataagcgtgaccaccgagatcctgcccgtgagcatgaccaagaccagcgtggactgtaccatgtacatctgcggcgacagcaccgagtgcagcaacctgttactgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggggactgcctgggcgacatcgccgcccgggacctgatctgcgctcagaagttcaacggcctgaccgtgctgccccctctgctgaccgatgagatgatcgcccagtacaccagcgccctgctggccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaactttggcgccatcagctcagtgctgaatgacatcctgagccggctggacaaggtggaggccgaggtgcagatcgacaggctgatcaccggccggctgcagagcctgcagacctacgtgacccagcagctgatccgggccgccgagattcgggccagcgccaacctggccgcaaccaagatgagcgagtgcgtgctgggccagagcaagcgggtggacttctgcggcaagggctaccacctgatgagcttcccccagagcgccccacacggcgtggtcttcctgcacgtgacatacgtgcccgcccaggagaagaacttcaccaccgcccccgccatctgccacgacggaaaggcccacttcccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctcgacaagtacttcaagaaccacaccagccccgacgtggacctgggcgacatcagcggcatcaacgctagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23258 - RNA, 4039 nt, synthetic construct
  misc_feature 1..4039: note = SARS-CoV-2/Wuhan/WIV05/2019__EPI_ISL_402128 spike protein mRNA gc (1-1273)(E484K_D614G)
  source 1..4039: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23259 - RNA, 4039 nt, synthetic construct
  misc_feature 1..4039: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4039: mol_type = other RNA
aggagaaagcttaccatgttcgtgttcctggtgctgctgcccctggtgagcagccagtgcgtgaacttcaccaaccggacccagctgcccagcgcctacaccaacagcttcacccggggcgtgtactaccctgacaaggtgttccggagcagcgtgctgcacagcacccaggacctgttcctgcccttcttcagcaacgtgacctggttccacgccatccacgtgagcggcaccaacggcaccaagcggttcgacaaccccgtgctgccattcaacgacggcgtgtacttcgccagcaccgagaagtcaaacatcatccggggctggatctttggcaccaccctggacagcaagacccagagcctgctgatcgtgaacaacgccacaaacgtggtgatcaaggtgtgcgagttccagttctgcaactaccccttcctgggcgtgtactaccacaagaacaacaagagctggatggagagcgagttccgggtctacagcagcgctaataactgcaccttcgagtacgtgagccagcccttcctgatggacctggagggcaagcagggcaacttcaagaacctcagcgagttcgtgttcaagaacatcgacggctacttcaagatctacagcaagcacacccccatcaacctggtgcgggatctgccccagggattcagcgccctggagcccctggtggacctgcctatcggcatcaacatcacccggttccagaccctgctggccctgcacaggagctacctgacccccggcgacagcagcagcggctggaccgccggcgccgccgcatactacgtgggctacctgcagccccggaccttcctgctgaagtacaacgagaacggcaccatcaccgacgccgtggactgcgccctggacccactgagcgagaccaagtgcaccctaaagagcttcaccgtggagaagggcatctaccagaccagcaacttccgggtgcagcccaccgagagcatcgtgcggttccccaacattactaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgctgacagcttcgtgatccggggcgacgaggtgcggcagatcgcccctggccagaccggcaccatcgccgactacaactacaagctgcccgacgacttcaccggctgcgtgatcgcctggaacagcaacaacctggacagcaaggtgggcggcaactacaactacctgtaccggctgttccgtaagagcaacctgaagccctttgagcgggacatcagcaccgagatctaccaggccggcagcaccccatgcaacggtgtgaagggcttcaactgctacttccccctgcagagctacggcttccagcccacctacggcgtgggctaccagccctaccgggtggtggtgctgagcttcgagctgctgcacgcccccgccaccgtgtgcggccccaaaaagagcaccaacctggtgaagaacaagtgcgtgaacttcaatttcaacggcctgaccggcaccggcgtgctgaccgagagcaacaagaagttcctgcctttccagcagttcggccgggacatcgccgataccaccgacgcagtgcgggacccccagaccctggagatcctggacatcaccccctgcagcttcggcggcgtgagcgtcatcaccccaggcacaaacaccagcaaccaggtggccgtgctgtaccagggagtgaactgcaccgaggtgcccgtggccatccacgccgaccagctgacccccacctggcgggtgtactccaccggcagcaacgtgttccagacccgggccggctgcctgatcggcgccgagtacgtgaacaacagctacgagtgcgacatccccatcggcgctggcatctgcgccagctaccagacccagaccaacagcccccggcgggcccggagcgtggccagccagagcatcatcgcctacaccatgagcctgggcgccgagaacagcgtggcctacagcaacaacagcatcgcgatccccaccaacttcaccatcagcgtgaccaccgagatattacctgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactccacccatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggacatcgccgctcgggatctgatctgcgcccagaagttcaacggcctgaccgtgctgcctcccctgctgaccgacgagatgatcgcccagtacaccagcgccctgctggccggcaccatcaccagcggctggaccttcggcgccggcgcagcccttcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagctcaaactttggcgccatcagcagcgtgctgaatgacatcctgagccggctggacaaggtggaggccgaggtgcagatcgacaggctgatcaccggccggctgcagagcctgcagacctacgtgacccagcagctgatccgggccgccgagatccgggccagcgccaacctggcagccattaagatgagcgagtgcgtgctgggccagagcaagcgggtggacttctgcggcaagggctaccacctgatgagcttcccccagagcgctccccacggcgtggtgttcctgcacgtcacctacgtgccagcccaggagaagaacttcacaaccgcccccgccatctgccacgacggcaaggcccacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctccagcccgagctggacagcttcaaggaggagctggacaagtacttcaagaaccacaccagccctgacgtggacctgggcgatatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23260 - RNA, 4039 nt, synthetic construct
  misc_feature 1..4039: note = SARS-CoV-2/Wuhan/WIV05/2019__EPI_ISL_402128 spike protein mRNA gc (1-1273)(S13I_W152C_L452R_D614G)
  source 1..4039: mol_type = other RNA
aggagaaagcttaccatgttcgtgttcctggtgctgctgcccctggtgagcatccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctgcatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgtaccctaaagagcttcaccgtggagaagggcatctaccagaccagcaacttccgggtgcagcccactgagagcattgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactaccggtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgtgcctcctaccagacccagaccaacagcccccggcgggcccggagcgtggccagccagagcatcatcgcctacaccatgagcctgggcgccgagaacagcgtggcctacagcaacaacagcatcgcgatccctaccaacttcaccataagcgtgaccaccgagatcttacccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgctggccggcaccatcaccagcggctggaccttcggcgccggcgcagcccttcagatccccttcgccatgcagatggcctacaggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagcagcgtgctgaatgacatcctgtcacggctggacaaggtggaggccgaggtgcagatcgaccggctgatcaccggccggctgcagagcctgcagacctacgtgacccagcagctgatccgggccgccgagattcgggccagcgccaacctggcagccaccaagatgagcgagtgcgtgctgggccagagcaagcgggtggacttttgcggcaagggctaccacctgatgagcttcccccagagcgccccacacggcgtggtgttcctgcacgtcacatacgtgcccgcccaggagaagaacttcaccaccgcccccgccatctgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctccagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgttgcagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23261 - RNA, 4039 nt, synthetic construct; identical to SEQ ID NO: 13012
  misc_feature 1..4039: note = SARS-CoV-2/Wuhan/WIV05/2019__EPI_ISL_402128 spike protein mRNA gc mod (1-1273)
  source 1..4039: mol_type = other RNA

SEQ ID NO: 23262 - RNA, 4039 nt, synthetic construct
  misc_feature 1..4039: note = SARS-CoV-2/Wuhan/WIV05/2019__EPI_ISL_402128 spike protein mRNA gc mod (1-1273)(D614G)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23263 - RNA, 4039 nt, synthetic construct
  misc_feature 1..4039: note = SARS-CoV-2/Wuhan/WIV05/2019__EPI_ISL_402128 spike protein mRNA gc mod (1-1273)(A222V_D614G)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23264 - RNA, 4039 nt, synthetic construct
  misc_feature 1..4039: note = SARS-CoV-2/Wuhan/WIV05/2019__EPI_ISL_402128 spike protein mRNA gc mod (1-1273)(N439K_D614G)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23265 - RNA, 4039 nt, synthetic construct
  misc_feature 1..4039: note = SARS-CoV-2/Wuhan/WIV05/2019__EPI_ISL_402128 spike protein mRNA gc mod (1-1273)(S477N_D614G)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23266 - RNA, 4039 nt, synthetic construct
  misc_feature 1..4039: note = SARS-CoV-2/Wuhan/WIV05/2019__EPI_ISL_402128 spike protein mRNA gc mod (1-1273)(N501Y_D614G)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23267 - RNA, 4033 nt, synthetic construct
  misc_feature 1..4033: note = SARS-CoV-2/Wuhan/WIV05/2019__EPI_ISL_402128 spike protein mRNA gc mod (1-1273)(H69del_V70del_D614G)
  source 1..4033: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23268 - RNA, 4039 nt, synthetic construct
  misc_feature 1..4039: note = SARS-CoV-2/Wuhan/WIV05/2019__EPI_ISL_402128 spike protein mRNA gc mod (1-1273)(Y453F_D614G)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23269 - RNA, 4039 nt, synthetic construct
  misc_feature 1..4039: note = SARS-CoV-2/Wuhan/WIV05/2019__EPI_ISL_402128 spike protein mRNA gc mod (1-1273)(D614G_I692V)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23270 - RNA, 4039 nt, synthetic construct
  misc_feature 1..4039: note = SARS-CoV-2/Wuhan/WIV05/2019__EPI_ISL_402128 spike protein mRNA gc mod (1-1273)(D614G_M1229I)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23271 - RNA, 4033 nt, synthetic construct
  misc_feature 1..4033: note = SARS-CoV-2/Wuhan/WIV05/2019__EPI_ISL_402128 spike protein mRNA gc mod (1-1273)(H69del_V70del_A222V_Y453F_S477N_D614G_I692V)
  source 1..4033: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23272 - RNA, 4033 nt, synthetic construct
  misc_feature 1..4033: note = SARS-CoV-2/Wuhan/WIV05/2019__EPI_ISL_402128 spike protein mRNA gc mod (1-1273)(H69del_V70del_Y453F_D614G_I692V_M1229I)
  source 1..4033: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23273 - RNA, 4030 nt, synthetic construct
  misc_feature 1..4030: note = SARS-CoV-2/Wuhan/WIV05/2019__EPI_ISL_402128 spike protein mRNA gc mod (1-1273)(H69del_V70del_Y144del_N501Y_A570D_D614G_P681H_T716 I_S982A_D1118H)
  source 1..4030: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccacagacgggctagaagcgtggccagccagagcatcattgcctacacaatgtctctgggcgccgagaacagcgtggcctactccaacaactctatcgctatccccatcaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23274 - RNA, 4039 nt, synthetic construct
  misc_feature 1..4039: note = SARS-CoV-2/Wuhan/WIV05/2019__EPI_ISL_402128 spike protein mRNA gc mod (1-1273)(K417N_E484K_N501Y_D614G)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23275 - RNA, 4030 nt, synthetic construct
  misc_feature 1..4030: note = SARS-CoV-2/Wuhan/WIV05/2019__EPI_ISL_402128 spike protein mRNA gc mod (1-1273)(L18F_D80A_D215G_L242del_A243del_L244del_R246I_K417 N_E484K_N501Y_D614G_A701V)
  source 1..4030: mol_type = other RNA
aggagaaagcttaccatgttcgtgtttctggtgctgctgcccctggtgtccagccagtgtgtgaacttcaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgtggagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23276 - RNA, 4039 nt, synthetic construct
  misc_feature 1..4039: note = SARS-CoV-2/Wuhan/WIV05/2019__EPI_ISL_402128 spike protein mRNA gc mod (1-1273)(E484K_D614G)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23277 - RNA, 4039 nt, synthetic construct
  misc_feature 1..4039: note = SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G _H655Y_T1027I)
  source 1..4039: mol_type = other RNA
aggagaaagcttaccatgttcgtgtttctggtgctgctgcccctggtgtccagccagtgtgtgaacttcaccaacagaacacagctgcctagcgcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23278 - RNA, 4039 nt, synthetic construct
  misc_feature 1..4039: note = SARS-CoV-2/Wuhan/WIV05/2019__EPI_ISL_402128 spike protein mRNA gc mod (1-1273)(S13I_W152C_L452R_D614G)
  source 1..4039: mol_type = other RNA
aggagaaagcttaccatgttcgtgtttctggtgctgctgcccctggtgtccatccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23279 - RNA, 4039 nt, synthetic construct
  misc_feature 1..4039: note = SARS-CoV-2/Wuhan/WIV05/2019__EPI_ISL_402128 spike protein mRNA gc mod (1-1273)
  source 1..4039: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23280 - RNA, 4039 nt, synthetic construct
  misc_feature 1..4039: note = SARS-CoV-2/Wuhan/WIV05/2019__EPI_ISL_402128 spike protein mRNA gc mod (1-1273)(D614G)
  source 1..4039: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23281 - RNA, 4039 nt, synthetic construct
  misc_feature 1..4039: note = SARS-CoV-2/Wuhan/WIV05/2019__EPI_ISL_402128 spike protein mRNA gc mod (1-1273)(A222V_D614G)
  source 1..4039: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23282 - RNA, 4039 nt, synthetic construct
  misc_feature 1..4039: note = SARS-CoV-2/Wuhan/WIV05/2019__EPI_ISL_402128 spike protein mRNA gc mod (1-1273)(N439K_D614G)
  source 1..4039: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23283 - RNA, 4039 nt, synthetic construct
  misc_feature 1..4039: note = SARS-CoV-2/Wuhan/WIV05/2019__EPI_ISL_402128 spike protein mRNA gc mod (1-1273)(S477N_D614G)
  source 1..4039: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23284 - RNA, 4039 nt, synthetic construct
  misc_feature 1..4039: note = SARS-CoV-2/Wuhan/WIV05/2019__EPI_ISL_402128 spike protein mRNA gc mod (1-1273)(N501Y_D614G)
  source 1..4039: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23285 - RNA, 4033 nt, synthetic construct
  misc_feature 1..4033: note = SARS-CoV-2/Wuhan/WIV05/2019__EPI_ISL_402128 spike protein mRNA gc mod (1-1273)(H69del_V70del_D614G)
  source 1..4033: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23286 - RNA, 4039 nt, synthetic construct
  misc_feature 1..4039: note = SARS-CoV-2/Wuhan/WIV05/2019__EPI_ISL_402128 spike protein mRNA gc mod (1-1273)(Y453F_D614G)
  source 1..4039: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23287 - RNA, 4039 nt, synthetic construct
  misc_feature 1..4039: note = SARS-CoV-2/Wuhan/WIV05/2019__EPI_ISL_402128 spike protein mRNA gc mod (1-1273)(D614G_I692V)
  source 1..4039: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23288 - RNA, 4039 nt, synthetic construct
  misc_feature 1..4039: note = SARS-CoV-2/Wuhan/WIV05/2019__EPI_ISL_402128 spike protein mRNA gc mod (1-1273)(D614G_M1229I)
  source 1..4039: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23289 - RNA, 4033 nt, synthetic construct
  misc_feature 1..4033: note = SARS-CoV-2/Wuhan/WIV05/2019__EPI_ISL_402128 spike protein mRNA gc mod (1-1273)(H69del_V70del_A222V_Y453F_S477N_D614G_I692V)
  source 1..4033: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23290 - RNA, 4033 nt, synthetic construct
  misc_feature 1..4033: note = SARS-CoV-2/Wuhan/WIV05/2019__EPI_ISL_402128 spike protein mRNA gc mod (1-1273)(H69del_V70del_Y453F_D614G_I692V_M1229I)
  source 1..4033: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23291 - RNA, 4030 nt, synthetic construct
  misc_feature 1..4030: note = SARS-CoV-2/Wuhan/WIV05/2019__EPI_ISL_402128 spike protein mRNA gc mod (1-1273)(H69del_V70del_Y144del_N501Y_A570D_D614G_P681H_T716 I_S982A_D1118H)
  source 1..4030: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccaccggagagccagaagcgtggccagccagagcatcattgcctacacaatgtctctgggcgccgagaacagcgtggcctactccaacaactctatcgctatccccatcaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23292 - RNA, 4039 nt, synthetic construct
  misc_feature 1..4039: note = SARS-CoV-2/Wuhan/WIV05/2019__EPI_ISL_402128 spike protein mRNA gc mod (1-1273)(K417N_E484K_N501Y_D614G)
  source 1..4039: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23293 - RNA, 4030 nt, synthetic construct
  misc_feature 1..4030: note = SARS-CoV-2/Wuhan/WIV05/2019__EPI_ISL_402128 spike protein mRNA gc mod (1-1273)(L18F_D80A_D215G_L242del_A243del_L244del_R246I_K417 N_E484K_N501Y_D614G_A701V)
  source 1..4030: mol_type = other RNA
aggagaaagcttaccatgttcgtgttcctggtgctgctgcctctggtgtccagccagtgtgtgaacttcaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgtggagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23294 - RNA, 4039 nt, synthetic construct
  misc_feature 1..4039: note = SARS-CoV-2/Wuhan/WIV05/2019__EPI_ISL_402128 spike protein mRNA gc mod (1-1273)(E484K_D614G)
  source 1..4039: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23295 - RNA, 4039 nt, synthetic construct
  misc_feature 1..4039: note = SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G _H655Y_T1027I)
  source 1..4039: mol_type = other RNA
aggagaaagcttaccatgttcgtgttcctggtgctgctgcctctggtgtccagccagtgtgtgaacttcaccaacagaacacagctgcctagcgcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23296 - RNA, 4039 nt, synthetic construct
  misc_feature 1..4039: note = SARS-CoV-2/Wuhan/WIV05/2019__EPI_ISL_402128 spike protein mRNA gc mod (1-1273)(S13I_W152C_L452R_D614G)
  source 1..4039: mol_type = other RNA
aggagaaagcttaccatgttcgtgttcctggtgctgctgcctctggtgtccatccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23297 - RNA, 4039 nt, synthetic construct; identical to SEQ ID NO: 163
  misc_feature 1..4039: note = SARS-CoV-2/Wuhan/WIV05/2019__EPI_ISL_402128 spike protein mRNA gc (1-1273)(K986P_V987P) R9515, R10157
  source 1..4039: mol_type = other RNA

SEQ ID NO: 23298 - RNA, 4039 nt, synthetic construct; identical to SEQ ID NO: 22819
  misc_feature 1..4039: note = SARS-CoV-2/Wuhan/WIV05/2019__EPI_ISL_402128 spike protein mRNA gc (1-1273)(K986P_V987P_ D614G) R10165
  source 1..4039: mol_type = other RNA

SEQ ID NO: 23299 - RNA, 4039 nt, synthetic construct; identical to SEQ ID NO: 22821
  misc_feature 1..4039: note = SARS-CoV-2/Wuhan/WIV05/2019__EPI_ISL_402128 spike protein mRNA gc (1-1273)(K986P_V987P_A222V_D614G) R10277
  source 1..4039: mol_type = other RNA

SEQ ID NO: 23300 - RNA, 4039 nt, synthetic construct; identical to SEQ ID NO: 22823
  misc_feature 1..4039: note = SARS-CoV-2/Wuhan/WIV05/2019__EPI_ISL_402128 spike protein mRNA gc (1-1273)(K986P_V987P_N439K_D614G) R10297
  source 1..4039: mol_type = other RNA

SEQ ID NO: 23301 - RNA, 4039 nt, synthetic construct; identical to SEQ ID NO: 22825
  misc_feature 1..4039: note = SARS-CoV-2/Wuhan/WIV05/2019__EPI_ISL_402128 spike protein mRNA gc (1-1273)(K986P_V987P_S477N_D614G) R10285
  source 1..4039: mol_type = other RNA

SEQ ID NO: 23302 - RNA, 4039 nt, synthetic construct; identical to SEQ ID NO: 22827
  misc_feature 1..4039: note = SARS-CoV-2/Wuhan/WIV05/2019__EPI_ISL_402128 spike protein mRNA gc (1-1273)(K986P_V987P_N501Y_D614G) R10351
  source 1..4039: mol_type = other RNA

SEQ ID NO: 23303 - RNA, 4033 nt, synthetic construct; identical to SEQ ID NO: 22829
  misc_feature 1..4033: note = SARS-CoV-2/Wuhan/WIV05/2019__EPI_ISL_402128 spike protein mRNA gc (1-1273)(K986P_V987P_H69del_V70del_D614G) R10273
  source 1..4033: mol_type = other RNA

SEQ ID NO: 23304 - RNA, 4039 nt, synthetic construct; identical to SEQ ID NO: 22831
  misc_feature 1..4039: note = SARS-CoV-2/Wuhan/WIV05/2019__EPI_ISL_402128 spike protein mRNA gc (1-1273)(K986P_V987P_Y453F_D614G) R10281
  source 1..4039: mol_type = other RNA

SEQ ID NO: 23305 - RNA, 4039 nt, synthetic construct; identical to SEQ ID NO: 22833
  misc_feature 1..4039: note = SARS-CoV-2/Wuhan/WIV05/2019__EPI_ISL_402128 spike protein mRNA gc (1-1273)(K986P_V987P_D614G_I692V) R10289
  source 1..4039: mol_type = other RNA

SEQ ID NO: 23306 - RNA, 4039 nt, synthetic construct; identical to SEQ ID NO: 22835
  misc_feature 1..4039: note = SARS-CoV-2/Wuhan/WIV05/2019__EPI_ISL_402128 spike protein mRNA gc (1-1273)(K986P_V987P_D614G_M1229I) R10345
  source 1..4039: mol_type = other RNA

SEQ ID NO: 23307 - RNA, 4033 nt, synthetic construct; identical to SEQ ID NO: 22837
  misc_feature 1..4033: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)R10293
  source 1..4033: mol_type = other RNA

SEQ ID NO: 23308 - RNA, 4033 nt, synthetic construct; identical to SEQ ID NO: 22839
  misc_feature 1..4033: note = SARS-CoV-2/Wuhan/WIV05/2019__EPI_ISL_402128 spike protein mRNA gc (1-1273)(K986P_V987P_H69del_V70del_Y453F_D614G_I692V_M1229I )R10347
  source 1..4033: mol_type = other RNA

SEQ ID NO: 23309 - RNA, 4030 nt, synthetic construct
  misc_feature 1..4030: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H) R10353
  source 1..4030: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgacgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactcccaccggcgcgcccggagcgtggcgtcccagagcatcatcgcctacaccatgtccctgggcgccgagaacagcgtcgcctactccaacaacagcatcgccatccccatcaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctcgcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccacccacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23310 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_K986P_V987P_K417N_E484K_N501Y_D614G) R10360
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23311 - RNA, 4030 nt, synthetic construct
  misc_feature 1..4030: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V) R10379
  source 1..4030: mol_type = other RNA
aggagaaagcttaccatgttcgtgttcctggtcctcctgcccctggtgagctcccagtgcgtgaacttcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgccaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccggggcctgccccaggggttcagcgccctcgagcccctggtggacctgcccatcggcatcaacatcacccgcttccagaccctccacatctcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgtggagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23312 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_K986P_V987P_E484K_D614G) R10378
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23313 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I) R10380
  source 1..4039: mol_type = other RNA
aggagaaagcttaccatgttcgtgttcctggtcctcctgcccctggtgagctcccagtgcgtgaacttcaccaaccgcacgcagctgccgagcgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaactaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctcagcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaccatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgatcaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23314 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_K986P_V987P_S13I_W152C_L452R_D614G) R10381
  source 1..4039: mol_type = other RNA
aggagaaagcttaccatgttcgtgttcctggtcctcctgcccctggtgagcatccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctgcatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactaccgctaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23315 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtccagatcgaccggctgatcaccgggcgcctccagagcctgcagacctacgtgacccagcagctgatccgggcggccgagatccgcgccagcgccaacctcgccgcgaccaagatgtccgagtgcgtgctgggccagagcaagcgggtcgacttctgcggcaaggggtaccacctgatgtccttcccccagagcgcgccccacggcgtggtgttcctccacgtcacgtacgtgcccgcccaggagaagaacttcaccaccgccccggccatctgccacgacgggaaggcccacttcccccgcgagggcgtcttcgtgtccaacgggacccactggttcgtgacgcagcggaacttctacgagccccagatcatcaccaccgacaacaccttcgtcagcggcaactgcgacgtggtgatcggcatcgtcaacaacacggtgtacgaccccctgcagccggagctggactccttcaaggaggagctcgacaagtacttcaagaaccacaccagccccgacgtggacctgggggacatctccggcatcaacgccagcgtcgtgaacatccagaaggagatcgaccgcctgaacgaggtggccaagaacctcaacgagtccctgatcgacctgcaggagctcgggaagtacgagcagtacatcaagtggccctggtacatctggctgggcttcatcgccggcctgatcgcgatcgtcatggtgaccatcatgctctgctgcatgaccagctgctgctcctgcctgaaggggtgctgcagctgcggctcctgctgcaagttcgacgaggacgacagcgagccggtgctgaagggggtcaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23316 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_ D614G)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23317 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_A222V_D614G)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtgctcgagcccctggtggacctgcccatcggcatcaacatcacccgcttccagaccctcctggccctgcaccggtcctacctcacgccgggggacagcagctccggctggaccgccggcgcggccgcctactacgtcgggtacctgcagccccgcaccttcctgctcaagtacaacgagaacggcaccatcacggacgccgtggactgcgcgctggaccccctgagcgagaccaagtgcaccctcaagtccttcaccgtggagaaggggatctaccagacgagcaacttccgggtccagcccaccgagtccatcgtgcgcttcccgaacatcaccaacctgtgccccttcggcgaggtcttcaacgccacccggttcgccagcgtgtacgcctggaaccgcaagcggatctccaactgcgtggccgactacagcgtcctgtacaactccgcgagcttctccacgttcaagtgctacggcgtgagccccaccaagctcaacgacctgtgcttcaccaacgtgtacgccgactccttcgtcatccgcggggacgaggtgcggcagatcgcccccggccagaccgggaagatcgccgactacaactacaagctgccggacgacttcacgggctgcgtgatcgcctggaacagcaacaacctcgactccaaggtcgggggcaactacaactacctgtaccgcctgttccgcaagagcaacctcaagcccttcgagcgggacatctccaccgagatctaccaggcgggcagcaccccctgcaacggggtggagggcttcaactgctacttccccctgcagtcctacgggttccagccgaccaacggcgtggggtaccagccctaccgggtcgtggtgctgagcttcgagctcctgcacgcccccgccacggtctgcggccccaagaagtccaccaacctggtgaagaacaagtgcgtgaacttcaacttcaacggcctcaccgggaccggcgtcctgaccgagagcaacaagaagttcctgccgttccagcagttcgggcgcgacatcgccgacacgaccgacgccgtgcgcgacccccagaccctggagatcctcgacatcaccccctgcagcttcggcggggtgtccgtcatcacgccgggcaccaacaccagcaaccaggtggcggtgctgtaccagggcgtcaactgcaccgaggtgcccgtggccatccacgccgaccagctgacgcccacctggcgggtctactccaccgggagcaacgtgttccagacccgcgccggctgcctcatcggggccgagcacgtgaacaactcctacgagtgcgacatccccatcggcgcgggcatctgcgccagctaccagacgcagaccaactccccgcggcgcgcccggagcgtcgcctcccagagcatcatcgcgtacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgccctgacgggcatcgcggtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacccgcccgaggccgaggtgcagatcgaccggctgatcaccggccgcctccagagcctgcagacctacgtgacccagcagctgatccgggccgcggagatccgcgccagcgccaacctcgccgccaccaagatgtccgagtgcgtcctgggccagagcaagcgggtggacttctgcgggaagggctaccacctgatgtccttcccccagagcgcgccccacggggtggtcttcctccacgtgacgtacgtccccgcccaggagaagaacttcaccaccgccccggccatctgccacgacggcaaggcgcacttcccccgcgagggggtgttcgtgtccaacggcacccactggttcgtcacgcagcggaacttctacgagccccagatcatcaccaccgacaacaccttcgtgagcggcaactgcgacgtggtcatcgggatcgtgaacaacacggtgtacgaccccctgcagccggagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccctggtacatctggctgggcttcatcgccgggctgatcgccatcgtgatggtgaccatcatgctctgctgcatgaccagctgctgctcctgcctgaagggctgctgcagctgcgggtcctgctgcaagttcgacgaggacgacagcgagccggtcctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23318 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_N439K_D614G)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23319 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_S477N_D614G)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgagcgtgatcacgccgggcaccaacacctccaaccaggtcgccgtgctgtaccagggcgtgaactgcaccgaggtccccgtggccatccacgccgaccagctgacgcccacctggcgggtgtacagcaccgggtccaacgtcttccagacccgcgccggctgcctcatcggggcggagcacgtgaacaacagctacgagtgcgacatccccatcggcgccggcatctgcgcctcctaccagacgcagaccaacagcccgcggcgcgcccggtccgtggcgagccagtccatcatcgcctacaccatgagcctgggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctcctgctgcagtacgggagcttctgcacccagctcaaccgcgcgctgacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacacctccgccctcctggcgggcaccatcacgagcgggtggaccttcggcgccggcgccgccctgcagatccccttcgcgatgcagatggcctaccggttcaacgggatcggcgtcacccagaacgtgctctacgagaaccagaagctgatcgccaaccagttcaactccgccatcgggaagatccaggacagcctgtccagcaccgcctccgcgctcggcaagctgcaggacgtggtcaaccagaacgcccaggccctgaacacgctcgtgaagcagctgagctccaacttcggggccatcagctccgtgctgaacgacatcctcagccgcctggacccgcccgaggccgaggtccagatcgaccggctgatcaccggccgcctccagtccctgcagacctacgtgacccagcagctgatccgggcggccgagatccgcgccagcgccaacctcgccgcgaccaagatgagcgagtgcgtgctgggccagtccaagcgggtcgacttctgcgggaagggctaccacctgatgagcttcccccagtccgcgccccacggggtggtgttcctccacgtcacgtacgtgcccgcccaggagaagaacttcaccaccgccccggccatctgccacgacggcaaggcccacttcccccgcgagggggtcttcgtgagcaacggcacccactggttcgtgacgcagcggaacttctacgagccccagatcatcaccaccgacaacaccttcgtctccggcaactgcgacgtggtgatcgggatcgtcaacaacacggtgtacgaccccctgcagccggagctggacagcttcaaggaggagctcgacaagtacttcaagaaccacacctcccccgacgtggacctgggcgacatcagcgggatcaacgcctccgtcgtgaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtcatggtgaccatcatgctctgctgcatgacctcctgctgcagctgcctgaagggctgctgctcctgcgggagctgctgcaagttcgacgaggacgactccgagccggtgctgaagggcgtcaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23320 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_N501Y_D614G)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23321 - RNA, 4033 nt, synthetic construct
  misc_feature 1..4033: note = SARS-CoV-2/Wuhan/WIV05/2019__EPI_ISL_402128 spike protein mRNA gc (1-1273)(K986P_V987P_H69del_V70del_D614G)
  source 1..4033: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtggcctactccaacaacagcatcgccatccccaccaacttcacgatctccgtcaccaccgagatcctgcccgtgagcatgaccaagacgagcgtggactgcaccatgtacatctgcggcgactccaccgagtgcagcaacctcctgctgcagtacgggtccttctgcacccagctcaaccgcgcgctgacgggcatcgccgtcgagcaggacaagaacacccaggaggtgttcgcccaggtgaagcagatctacaagacgcccccgatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtcctctacgagaaccagaagctgatcgccaaccagttcaacagcgccatcgggaagatccaggactccctgagctccaccgccagcgcgctcggcaagctgcaggacgtggtgaaccagaacgcccaggccctgaacacgctcgtcaagcagctgtccagcaacttcggggccatctccagcgtgctgaacgacatcctctcccgcctggacccgcccgaggccgaggtgcagatcgaccggctgatcaccggccgcctccagagcctgcagacctacgtcacccagcagctgatccgggcggccgagatccgcgccagcgccaacctcgccgcgaccaagatgtccgagtgcgtgctgggccagagcaagcgggtggacttctgcgggaagggctaccacctgatgtccttcccccagagcgcgccccacggggtcgtgttcctccacgtgacgtacgtccccgcccaggagaagaacttcaccaccgccccggccatctgccacgacggcaaggcccacttcccccgcgagggggtgttcgtctccaacggcacccactggttcgtgacgcagcggaacttctacgagccccagatcatcaccaccgacaacaccttcgtgagcggcaactgcgacgtcgtgatcgggatcgtgaacaacacggtctacgaccccctgcagccggagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtgatggtcaccatcatgctctgctgcatgaccagctgctgctcctgcctgaagggctgctgcagctgcgggtcctgctgcaagttcgacgaggacgacagcgagccggtgctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23322 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_Y453F_D614G)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23323 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_D614G_I692V)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcgtcatcgcctacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgcgctgacgggcatcgccgtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtcctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtgctctacgagaaccagaagctgatcgccaaccagttcaacagcgccatcgggaagatccaggactccctgagctccaccgccagcgcgctcggcaagctgcaggacgtcgtgaaccagaacgcccaggccctgaacacgctcgtgaagcagctgtccagcaacttcggggccatctccagcgtcctgaacgacatcctctcccgcctggacccgcccgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgcgccccacggggtggtcttcctccacgtgacgtacgtccccgcccaggagaagaacttcaccaccgccccggccatctgccacgacggcaaggcccacttcccccgcgagggggtgttcgtgtccaacggcacccactggttcgtcacgcagcggaacttctacgagccccagatcatcaccaccgacaacaccttcgtgagcggcaactgcgacgtggtcatcgggatcgtgaacaacacggtgtacgaccccctgcagccggagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccctggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagccggtcctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23324 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_D614G_M1229I)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatcgtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23325 - RNA, 4033 nt, synthetic construct
  misc_feature 1..4033: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4033: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgtcctcgagcccctggtggacctgcccatcggcatcaacatcacccgcttccagaccctcctggccctgcaccggtcctacctcacgccgggggacagcagctccggctggaccgccggcgcggccgcctactacgtggggtacctgcagccccgcaccttcctgctcaagtacaacgagaacggcaccatcacggacgccgtcgactgcgcgctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggccgactacagcgtgctgtacaactccgcgagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcctggaacagcaacaacctcgactccaaggtcgggggcaactacaactacctgttccgcctgttccgcaagagcaacctcaagcccttcgagcgggacatctccaccgagatctaccaggcgggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgccgtccgcgacccccagaccctggagatcctcgacatcaccccctgcagcttcggcggggtgagcgtgatcacgccgggcaccaacacctccaaccaggtcgcggtgctgtaccagggcgtgaactgcaccgaggtccccgtggccatccacgccgaccagctgacgcccacctggcgggtgtacagcaccgggtccaacgtcttccagacccgcgccggctgcctcatcggggccgagcacgtgaacaacagctacgagtgcgacatccccatcggcgcgggcatctgcgcctcctaccagacgcagaccaacagcccgcggcgcgcccggtccgtggccagccagtccgtcatcgcgtacaccatgagcctgggggccgagaactccgtggcctacagcaacaactccatcgccatccccaccaacttcacgatcagcgtgaccaccgagatcctgcccgtctccatgaccaagacgagcgtggactgcaccatgtacatctgcggcgacagcaccgagtgctccaacctcctgctgcagtacgggagcttctgcacccagctcaaccgcgccctgacgggcatcgcggtggagcaggacaagaacacccaggaggtcttcgcccaggtgaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacacctccgccctcctggccggcaccatcacgagcgggtggaccttcggcgcgggcgccgccctgcagatccccttcgccatgcagatggcgtaccggttcaacgggatcggcgtgacccagaacgtgctctacgagaaccagaagctgatcgccaaccagttcaactccgccatcgggaagatccaggacagcctgtccagcaccgcctccgccctcggcaagctgcaggacgtcgtgaaccagaacgcgcaggccctgaacacgctcgtgaagcagctgagctccaacttcggggccatcagctccgtcctgaacgacatcctcagccgcctggacccgcccgaggccgaggtgcagatcgaccggctgatcaccggccgcctccagtccctgcagacctacgtgacccagcagctgatccgggccgcggagatccgcgccagcgccaacctcgccgccaccaagatgagcgagtgcgtcctgggccagtccaagcgggtggacttctgcgggaagggctaccacctgatgagcttcccccagtccgcgccccacggggtggtcttcctccacgtgacgtacgtccccgcccaggagaagaacttcaccaccgccccggccatctgccacgacggcaaggcgcacttcccccgcgagggggtgttcgtgagcaacggcacccactggttcgtcacgcagcggaacttctacgagccccagatcatcaccaccgacaacaccttcgtgtccggcaactgcgacgtggtcatcgggatcgtgaacaacacggtgtacgaccccctgcagccggagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccctggtacatctggctgggcttcatcgccgggctgatcgccatcgtgatggtgaccatcatgctctgctgcatgacctcctgctgcagctgcctgaagggctgctgctcctgcgggagctgctgcaagttcgacgaggacgactccgagccggtcctgaagggcgtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23326 - RNA, 4033 nt, synthetic construct
  misc_feature 1..4033: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4033: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcgtgatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatcgtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23327 - RNA, 4030 nt, synthetic construct
  misc_feature 1..4030: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4030: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgacgacacgaccgacgccgtgcgcgacccccagaccctggagatcctcgacatcaccccctgcagcttcggcggggtctccgtgatcacgccgggcaccaacaccagcaaccaggtggcggtcctgtaccagggcgtgaactgcaccgaggtgcccgtcgccatccacgccgaccagctgacgcccacctggcgggtgtactccaccgggagcaacgtgttccagacccgcgccggctgcctcatcggggccgagcacgtcaacaactcctacgagtgcgacatccccatcggcgcgggcatctgcgccagctaccagacgcagaccaactcccaccggcgcgcccggagcgtggcctcccagagcatcatcgcgtacaccatgtccctgggggccgagaacagcgtggcctactccaacaacagcatcgccatcccgatcaacttcaccatctccgtcacgaccgagatcctgcccgtgagcatgaccaagaccagcgtggactgcacgatgtacatctgcggcgactccaccgagtgcagcaacctcctgctgcagtacgggtccttctgcacccagctcaaccgcgccctgaccggcatcgcggtcgagcaggacaagaacacgcaggaggtgttcgcccaggtgaagcagatctacaagaccccgcccatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgccgcgcgcgacctgatctgcgcccagaagttcaacgggctgaccgtgctgcccccgctcctgacggacgagatgatcgcccagtacaccagcgccctcctggccggcaccatcacctccgggtggacgttcggcgcgggcgccgccctgcagatccccttcgccatgcagatggcgtaccggttcaacgggatcggcgtgacccagaacgtcctctacgagaaccagaagctgatcgccaaccagttcaacagcgccatcgggaagatccaggactccctgagctccaccgccagcgccctcggcaagctgcaggacgtggtgaaccagaacgcgcaggccctgaacaccctcgtcaagcagctgtccagcaacttcggggccatctccagcgtgctgaacgacatcctcgcccgcctggacccgcccgaggccgaggtgcagatcgaccggctgatcacgggccgcctccagtccctgcagacctacgtcacccagcagctgatccgggcggccgagatccgcgccagcgccaacctcgccgcgaccaagatgagcgagtgcgtgctgggccagtccaagcgggtggacttctgcgggaagggctaccacctgatgagcttcccccagtccgcgccccacggggtcgtgttcctccacgtgacctacgtccccgcccaggagaagaacttcacgaccgcccccgccatctgccacgacggcaaggcccacttcccgcgcgagggggtgttcgtcagcaacggcacccactggttcgtgacccagcggaacttctacgagccccagatcatcacgacccacaacaccttcgtgtccggcaactgcgacgtcgtgatcgggatcgtgaacaacaccgtctacgaccccctgcagcccgagctggacagcttcaaggaggagctcgacaagtacttcaagaaccacacgtccccggacgtggacctgggcgacatcagcgggatcaacgcctccgtggtcaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtgatggtcaccatcatgctctgctgcatgacctcctgctgcagctgcctgaagggctgctgctcctgcgggagctgctgcaagttcgacgaggacgactccgagcccgtgctgaagggcgtgaagctccactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23328 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23329 - RNA, 4030 nt, synthetic construct
  misc_feature 1..4030: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4030: mol_type = other RNA
aggagaaagcttaccatgttcgtgttcctggtcctcctgcccctggtgagctcccagtgcgtgaacttcaccacccgcacgcagctcccgcccgcctacaccaacagcttcacccggggcgtctactaccccgacaaggtgttccgctccagcgtgctgcactccacccaggacctgttcctccccttcttcagcaacgtcacgtggttccacgccatccacgtgtccgggaccaacggcaccaagcggttcgcgaacccggtgctgcccttcaacgacggggtctacttcgccagcaccgagaagtccaacatcatccgcggctggatcttcgggacgaccctggacagcaagacccagtccctcctgatcgtgaacaacgccaccaacgtggtcatcaaggtgtgcgagttccagttctgcaacgaccccttcctgggcgtgtactaccacaagaacaacaagagctggatggagtccgagttccgggtctacagctccgccaacaactgcacgttcgagtacgtgagccagcccttcctcatggacctggagggcaagcaggggaacttcaagaacctgcgcgagttcgtgttcaagaacatcgacggctacttcaagatctactccaagcacaccccgatcaacctcgtccgggggctgccccagggcttcagcgccctggagcccctcgtggacctgcccatcgggatcaacatcacccgcttccagaccctgcacatctcctacctcacgccgggcgacagcagctccggctggaccgcgggggccgccgcctactacgtgggctacctgcagccccggaccttcctgctcaagtacaacgagaacgggaccatcacggacgcggtcgactgcgccctggaccccctgagcgagaccaagtgcaccctcaagtccttcaccgtggagaagggcatctaccagacgagcaacttccgcgtgcagcccaccgagtccatcgtccggttcccgaacatcaccaacctgtgccccttcggcgaggtgttcaacgccacccgcttcgccagcgtctacgcctggaaccggaagcgcatctccaactgcgtggcggactacagcgtgctgtacaactccgccagcttctccacgttcaagtgctacggggtcagccccaccaagctcaacgacctgtgcttcaccaacgtgtacgccgactccttcgtgatccggggcgacgaggtccgccagatcgcccccgggcagaccggcaacatcgccgactacaactacaagctgccggacgacttcacggggtgcgtgatcgcgtggaacagcaacaacctcgactccaaggtgggcggcaactacaactacctgtaccggctgttccgcaagagcaacctcaagcccttcgagcgggacatctccaccgagatctaccaggccgggagcaccccctgcaacggcgtcaaggggttcaactgctacttccccctgcagtcctacggcttccagccgacctacggggtgggctaccagccctaccgcgtggtcgtgctgagcttcgagctcctgcacgcccccgccacggtgtgcggccccaagaagtccaccaacctggtcaagaacaagtgcgtgaacttcaacttcaacgggctcaccggcaccggggtgctgaccgagagcaacaagaagttcctgccgttccagcagttcggccgggacatcgccgacacgaccgacgcggtccgcgacccccagaccctcgagatcctggacatcaccccctgcagcttcgggggcgtgtccgtgatcacgccgggcaccaacaccagcaaccaggtcgccgtgctgtaccagggggtgaactgcaccgaggtccccgtggccatccacgccgaccagctgacgcccacctggcgcgtgtactccaccggcagcaacgtcttccagacccgggccgggtgcctcatcggcgcggagcacgtgaacaactcctacgagtgcgacatccccatcggcgccgggatctgcgccagctaccagacgcagaccaactccccgcgccgggcccgcagcgtggcgtcccagagcatcatcgcctacaccatgtccctgggcgtcgagaacagcgtggcctactccaacaacagcatcgccatccccaccaacttcacgatctccgtgaccaccgagatcctgcccgtcagcatgaccaagacgagcgtggactgcaccatgtacatctgcggggactccaccgagtgcagcaacctcctgctgcagtacggctccttctgcacccagctcaaccgggccctgacggggatcgcggtggagcaggacaagaacacccaggaggtcttcgcccaggtgaagcagatctacaagacgcccccgatcaaggacttcggcggcttcaacttcagccagatcctgcccgacccctccaagcccagcaagcgctccttcatcgaggacctcctgttcaacaaggtgaccctggccgacgccgggttcatcaagcagtacggcgactgcctcggggacatcgccgcgcgggacctgatctgcgcccagaagttcaacggcctgaccgtcctcccgcccctgctgaccgacgagatgatcgcccagtacaccagcgccctcctggccgggaccatcacgtccggctggaccttcggcgcgggggccgccctgcagatccccttcgccatgcagatggcgtaccgcttcaacggcatcggggtgacccagaacgtgctctacgagaaccagaagctgatcgccaaccagttcaacagcgccatcggcaagatccaggactccctgagctccaccgccagcgccctcgggaagctgcaggacgtcgtgaaccagaacgcgcaggccctgaacacgctcgtgaagcagctgtccagcaacttcggcgccatctccagcgtcctgaacgacatcctctcccggctggacccgcccgaggccgaggtgcagatcgaccgcctgatcaccggccggctccagagcctgcagacctacgtgacccagcagctgatccgcgccgcggagatccgggccagcgccaacctcgccgccaccaagatgtccgagtgcgtcctggggcagagcaagcgcgtggacttctgcggcaaggggtaccacctgatgtccttcccccagagcgcgccccacggcgtggtcttcctccacgtgacgtacgtccccgcccaggagaagaacttcaccaccgccccggccatctgccacgacgggaaggcgcacttcccccgggagggcgtgttcgtgtccaacggcacccactggttcgtcacgcagcgcaacttctacgagccccagatcatcaccaccgacaacaccttcgtgagcgggaactgcgacgtggtcatcggcatcgtgaacaacacggtgtacgaccccctgcagccggagctggactccttcaaggaggagctcgacaagtacttcaagaaccacaccagccccgacgtcgacctgggggacatctccggcatcaacgccagcgtggtgaacatccagaaggagatcgaccggctgaacgaggtcgccaagaacctcaacgagtccctgatcgacctgcaggagctcggcaagtacgagcagtacatcaagtggccctggtacatctggctggggttcatcgccggcctgatcgccatcgtgatggtgaccatcatgctctgctgcatgaccagctgctgctcctgcctgaaggggtgctgcagctgcggctcctgctgcaagttcgacgaggacgacagcgagccggtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23330 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_K986P_V987P_E484K_D614G)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23331 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4039: mol_type = other RNA
aggagaaagcttaccatgttcgtgttcctggtcctcctgcccctggtgagctcccagtgcgtgaacttcaccaaccgcacccagctcccgagcgcctacacgaactccttcacccggggcgtctactaccccgacaaggtgttccgcagctccgtgctgcacagcacccaggacctgttcctccccttcttctccaacgtcacctggttccacgccatccacgtgagcgggacgaacggcaccaagcggttcgacaaccccgtgctgccgttcaacgacggggtctacttcgcgtccaccgagaagtccaacatcatccgcggctggatcttcgggaccacgctggactccaagacccagagcctcctgatcgtgaacaacgccaccaacgtggtcatcaaggtgtgcgagttccagttctgcaactaccccttcctgggcgtgtactaccacaagaacaacaagtcctggatggagagcgagttccgggtctactccagcgccaacaactgcaccttcgagtacgtgtcccagcccttcctcatggacctggagggcaagcaggggaacttcaagaacctgagcgagttcgtgttcaagaacatcgacggctacttcaagatctactccaagcacacgcccatcaacctcgtccgcgacctgccgcaggggttcagcgccctggagcccctcgtggacctgcccatcggcatcaacatcacccggttccagaccctgctcgccctgcaccgcagctacctgacccccggggactccagctccggctggacggcgggcgccgccgcctactacgtggggtacctccagccgcggaccttcctgctgaagtacaacgagaacggcaccatcaccgacgcggtcgactgcgccctcgaccccctgagcgagacgaagtgcaccctgaagtccttcaccgtggagaaggggatctaccagaccagcaacttccgcgtgcagcccacggagtccatcgtccggttccccaacatcaccaacctctgcccgttcggcgaggtgttcaacgccacccgcttcgccagcgtctacgcctggaaccggaagcgcatctccaactgcgtggcggactacagcgtgctgtacaactccgccagcttctccaccttcaagtgctacggcgtcagccccacgaagctgaacgacctctgcttcaccaacgtgtacgccgactccttcgtgatccgcggggacgaggtccggcagatcgcccccggccagaccgggaccatcgccgactacaactacaagctgcccgacgacttcacgggctgcgtgatcgcgtggaacagcaacaacctggactccaaggtcgggggcaactacaactacctctaccggctgttccgcaagagcaacctgaagccgttcgagcgggacatctccaccgagatctaccaggccggcagcaccccctgcaacggggtgaagggcttcaactgctacttccccctccagagctacgggttccagcccacctacggcgtggggtaccagccgtaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgcccttccagcagttcgggcgggacatcgccgacacgaccgacgcggtccgcgacccgcagaccctggagatcctggacatcaccccctgcagcttcggcggggtgtccgtgatcacgcccggcaccaacaccagcaaccaggtcgccgtgctctaccagggcgtgaactgcaccgaggtcccggtggccatccacgccgaccagctgacgcccacctggcgcgtgtactccaccgggagcaacgtcttccagacccgggccggctgcctgatcggggcggagtacgtgaacaactcctacgagtgcgacatccccatcggcgccggcatctgcgccagctaccagacgcagaccaacagcccccgccgggcccgcagcgtggcgtcccagagcatcatcgcctacaccatgtccctcggggccgagaacagcgtcgcctactccaacaacagcatcgccatcccgaccaacttcacgatcagcgtgaccaccgagatcctgcccgtgtccatgaccaagacgagcgtcgactgcaccatgtacatctgcggcgactccaccgagtgcagcaacctgctcctgcagtacgggtccttctgcacccagctgaaccgggcgctcacgggcatcgccgtggagcaggacaagaacacccaggaggtgttcgcccaggtcaagcagatctacaagaccccgcccatcaaggacttcgggggcttcaacttcagccagatcctgcccgacccctccaagcccagcaagcgctccttcatcgaggacctcctgttcaacaaggtgaccctggccgacgccggcttcatcaagcagtacggggactgcctgggcgacatcgcggcccgggacctcatctgcgcccagaagttcaacgggctgacggtgctgcccccgctcctgaccgacgagatgatcgcccagtacaccagcgccctgctcgcgggcaccatcacgtccgggtggaccttcggcgccggcgccgccctgcagatccccttcgcgatgcagatggcctaccgcttcaacgggatcggcgtcacccagaacgtgctgtacgagaaccagaagctcatcgccaaccagttcaacagcgccatcgggaagatccaggactccctgagctccaccgccagcgcgctgggcaagctccaggacgtggtcaaccagaacgcccaggccctgaacacgctggtgaagcagctctccagcaacttcggggccatctccagcgtgctgaacgacatcctgagccggctcgacccgcccgaggccgaggtccagatcgaccgcctgatcaccggccggctgcagtccctccagacctacgtgacccagcagctgatccgcgcggccgagatccgggccagcgccaacctggccgcgatcaagatgtccgagtgcgtgctcggccagagcaagcgcgtcgacttctgcgggaagggctaccacctgatgtccttcccccagagcgcgccccacggggtggtgttcctgcacgtcacctacgtgcccgcccaggagaagaacttcacgaccgcccccgccatctgccacgacggcaaggcccacttcccgcgggagggggtcttcgtgtccaacggcacccactggttcgtgacccagcgcaacttctacgagccccagatcatcacgaccgacaacaccttcgtcagcggcaactgcgacgtggtgatcgggatcgtcaacaacaccgtgtacgaccccctccagcccgagctggactccttcaaggaggagctggacaagtacttcaagaaccacacgagcccggacgtggacctcggcgacatctccgggatcaacgccagcgtcgtgaacatccagaaggagatcgaccggctgaacgaggtggccaagaacctgaacgagtccctcatcgacctgcaggagctgggcaagtacgagcagtacatcaagtggccctggtacatctggctcggcttcatcgccgggctgatcgcgatcgtcatggtgaccatcatgctgtgctgcatgaccagctgctgctcctgcctcaagggctgctgcagctgcgggtcctgctgcaagttcgacgaggacgacagcgagcccgtgctgaagggcgtcaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23332 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4039: mol_type = other RNA
aggagaaagcttaccatgttcgtgttcctggtcctcctgcccctggtgagcatccagtgcgtgaacctcaccacccgcacgcagctgccgcccgcctacaccaactccttcacccggggcgtctactaccccgacaaggtgttccgcagctccgtgctgcacagcacccaggacctcttcctgcccttcttctccaacgtcacgtggttccacgccatccacgtgagcgggaccaacggcaccaagcggttcgacaacccggtgctgcccttcaacgacggggtctacttcgcgtccaccgagaagtccaacatcatccgcggctggatcttcgggacgaccctcgacagcaagacccagagcctgctgatcgtgaacaacgccaccaacgtggtcatcaaggtgtgcgagttccagttctgcaacgaccccttcctcggcgtgtactaccacaagaacaacaagtcctgcatggagagcgagttccgggtctactccagcgccaacaactgcacgttcgagtacgtgtcccagcccttcctgatggacctggagggcaagcaggggaacttcaagaacctccgcgagttcgtgttcaagaacatcgacggctacttcaagatctacagcaagcacaccccgatcaacctggtccgggacctgccccaggggttctccgccctcgagcccctggtggacctgcccatcggcatcaacatcacccgcttccagaccctcctggccctgcaccggagctacctcacgccgggggactccagcagcggctggaccgcgggcgccgccgcctactacgtggggtacctgcagccccgcaccttcctgctcaagtacaacgagaacggcaccatcacggacgcggtcgactgcgccctggaccccctgtccgagaccaagtgcaccctcaagagcttcaccgtggagaaggggatctaccagacgtccaacttccgggtgcagcccaccgagagcatcgtccgcttcccgaacatcaccaacctgtgccccttcggcgaggtgttcaacgccacccggttcgcctccgtctacgcctggaaccgcaagcggatcagcaactgcgtggcggactactccgtgctgtacaacagcgcctccttcagcacgttcaagtgctacggcgtctcccccaccaagctcaacgacctgtgcttcaccaacgtgtacgccgacagcttcgtgatccgcggggacgaggtccggcagatcgcccccggccagaccgggaagatcgccgactacaactacaagctgccggacgacttcacgggctgcgtgatcgcgtggaactccaacaacctcgacagcaaggtcgggggcaactacaactaccgctaccggctgttccgcaagtccaacctgaagcccttcgagcgggacatcagcaccgagatctaccaggccggctccaccccctgcaacggggtggagggcttcaactgctacttccccctccagagctacgggttccagccgaccaacggcgtggggtaccagccctaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgccgttccagcagttcgggcgcgacatcgccgacacgaccgacgcggtccgggacccccagaccctggagatcctggacatcaccccctgcagcttcggcggggtgagcgtgatcacgccgggcaccaacacctccaaccaggtcgccgtgctctaccagggcgtgaactgcaccgaggtccccgtggccatccacgccgaccagctgacgcccacctggcgcgtgtacagcaccgggtccaacgtcttccagacccgggccggctgcctgatcggggcggagcacgtgaacaacagctacgagtgcgacatccccatcggcgccggcatctgcgcctcctaccagacgcagaccaacagcccgcgccgggcccgctccgtggcgagccagtccatcatcgcctacaccatgagcctcggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctgctcctgcagtacgggagcttctgcacccagctgaaccgggcgctcacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcgcagcttcatcgaggacctcctgttcaacaaggtgaccctggccgacgccggcttcatcaagcagtacggggactgcctgggcgacatcgcggcccgggacctcatctgcgcccagaagttcaacgggctgaccgtgctgccgcccctcctgaccgacgagatgatcgcccagtacacctccgccctgctcgcgggcaccatcacgagcgggtggaccttcggcgccggcgccgccctgcagatccccttcgcgatgcagatggcctaccgcttcaacgggatcggcgtcacccagaacgtgctgtacgagaaccagaagctcatcgccaaccagttcaactccgccatcgggaagatccaggacagcctgtccagcaccgcctccgcgctgggcaagctccaggacgtggtcaaccagaacgcccaggccctgaacacgctggtgaagcagctcagctccaacttcggggccatcagctccgtgctgaacgacatcctgagccggctcgacccgcccgaggccgaggtccagatcgaccgcctgatcaccggccggctgcagtccctccagacctacgtgacccagcagctgatccgcgcggccgagatccgggccagcgccaacctggccgcgaccaagatgagcgagtgcgtgctcggccagtccaagcgcgtcgacttctgcgggaagggctaccacctgatgagcttcccccagtccgcgccccacggggtggtgttcctgcacgtcacgtacgtgcccgcccaggagaagaacttcaccaccgccccggccatctgccacgacggcaaggcccacttcccccgggagggggtcttcgtgagcaacggcacccactggttcgtgacgcagcgcaacttctacgagccccagatcatcaccaccgacaacaccttcgtctccggcaactgcgacgtggtgatcgggatcgtcaacaacacggtgtacgaccccctccagccggagctggacagcttcaaggaggagctggacaagtacttcaagaaccacacctcccccgacgtggacctcggcgacatcagcgggatcaacgcctccgtcgtgaacatccagaaggagatcgaccggctgaacgaggtggccaagaacctgaacgagagcctcatcgacctgcaggagctgggcaagtacgagcagtacatcaagtggccctggtacatctggctcggcttcatcgccgggctgatcgcgatcgtcatggtgaccatcatgctgtgctgcatgacctcctgctgcagctgcctcaagggctgctgctcctgcgggagctgctgcaagttcgacgaggacgactccgagccggtgctgaagggcgtcaagctgcactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23333 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P)
  source 1..4039: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccaggacgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23334 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_ D614G)
  source 1..4039: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23335 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_A222V_D614G)
  source 1..4039: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23336 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_N439K_D614G)
  source 1..4039: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaagaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23337 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_S477N_D614G)
  source 1..4039: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23338 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_N501Y_D614G)
  source 1..4039: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23339 - RNA, 4033 nt, synthetic construct
  misc_feature 1..4033: note = SARS-CoV-2/Wuhan/WIV05/2019__EPI_ISL_402128 spike protein mRNA gc (1-1273)(K986P_V987P_H69del_V70del_D614G)
  source 1..4033: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23340 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_Y453F_D614G)
  source 1..4039: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23341 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_D614G_I692V)
  source 1..4039: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23342 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_D614G_M1229I)
  source 1..4039: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23343 - RNA, 4033 nt, synthetic construct
  misc_feature 1..4033: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4033: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23344 - RNA, 4033 nt, synthetic construct
  misc_feature 1..4033: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4033: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23345 - RNA, 4030 nt, synthetic construct
  misc_feature 1..4030: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4030: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgacgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcacaccggagggcaaggagcgtggccagccagagcatcatcgcctacaccatgagcctgggcgccgagaacagcgtggcctacagcaacaacagcatcgccatccccatcaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctggcccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23346 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4039: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23347 - RNA, 4030 nt, synthetic construct
  misc_feature 1..4030: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4030: mol_type = other RNA
aggagaaagcttaccatgttcgtgttcctggtgctgctgcccctggtgagcagccagtgcgtgaacttcaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgccaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcggggcctgccccagggcttctcagccctggagcccctggtggacctgcccatcggcatcaacatcacccggttccagaccctgcacatcagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgtggagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23348 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_K986P_V987P_E484K_D614G)
  source 1..4039: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23349 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4039: mol_type = other RNA
aggagaaagcttaccatgttcgtgttcctggtgctgctgcccctggtgagcagccagtgcgtgaacttcaccaaccggacccagctgccaagcgcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaactaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgagcgagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaccatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagtacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccatcaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23350 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4039: mol_type = other RNA
aggagaaagcttaccatgttcgtgttcctggtgctgctgcccctggtgagcatccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctgcatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactaccgctaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23351 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P)
  source 1..4039: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccaggacgtgaactgcaccgaggtgcccgtggccatccacgccgaccagctgacccccacctggcgggtgtacagcaccggaagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgattgcctgggcgacatcgccgctcgggacctgatctgcgcccagaagttcaacgggctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggcgtgttcgtgagcaacggaacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23352 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_ D614G)
  source 1..4039: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23353 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_A222V_D614G)
  source 1..4039: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtcagcgtgatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagcccccggcgggcccggagcgtggccagccagagcatcatcgcctacaccatgagcttaggcgccgagaacagcgtggcctacagcaacaacagcatcgccatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttttgcggcaagggctaccacctgatgagcttcccccagagcgctccccacggcgtggtgttcctccacgtcacatacgtgcccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23354 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_N439K_D614G)
  source 1..4039: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaagaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggatcccccagaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23355 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_S477N_D614G)
  source 1..4039: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcaacaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgcgcctcctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaatttcggcgccatcagcagcgtgctgaacgacatcctgtcaaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23356 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_N501Y_D614G)
  source 1..4039: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggatcccccagaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23357 - RNA, 4033 nt, synthetic construct
  misc_feature 1..4033: note = SARS-CoV-2/Wuhan/WIV05/2019__EPI_ISL_402128 spike protein mRNA gc (1-1273)(K986P_V987P_H69del_V70del_D614G)
  source 1..4033: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtgcccgcccaggagaagaacttcaccaccgcccccgccatttgccacgacggcaaggcccacttcccccgggagggagtcttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23358 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_Y453F_D614G)
  source 1..4039: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23359 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_D614G_I692V)
  source 1..4039: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtcacatacgtgcccgcccaggagaagaacttcaccaccgcccccgccatctgccacgacggcaaggcccacttcccccgggagggagtgttcgtgagcaacggcacccactggttcgtgacccagcggaacttctacgagcctcagattatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23360 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_D614G_M1229I)
  source 1..4039: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23361 - RNA, 4033 nt, synthetic construct
  misc_feature 1..4033: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4033: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcaacaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtgagcgtcatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgccggcatctgcgcttcctaccagacccagaccaacagcccccggcgggcccggagcgtggccagccagagcgtgatcgcctacaccatgagcttaggcgccgagaacagcgtggcctacagcaacaacagcatcgccatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaattttggcgccatcagcagcgtgctgaacgacatcctgtcaaggctggatcccccagaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttctgcggcaagggctaccacctgatgagcttcccccagagcgctccccacggcgtggtgttcctccacgtcacatacgtgcccgcccaggagaagaacttcaccaccgcccccgccatctgccacgacggcaaggcccacttcccccgggagggagtgttcgtgagcaacggcacccactggttcgtgacccagcggaacttctacgagcctcagattatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23362 - RNA, 4033 nt, synthetic construct
  misc_feature 1..4033: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4033: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgctccccacggcgtggtgttcctccacgtgacatacgtccccgcccaggagaagaacttcaccaccgcccccgccatctgccacgacggcaaggcccacttcccccgggagggagtgttcgtgagcaacggcacccactggttcgtgacccagcggaacttctacgagcctcagattatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23363 - RNA, 4030 nt, synthetic construct
  misc_feature 1..4030: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4030: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgacgacaccaccgacgccgtgcgggacccccagaccctggagatcctggacatcaccccatgcagcttcggcggcgtgagcgtgatcacccccggcacaaacaccagcaaccaggtcgcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagccaccggcgggcccggagcgtggccagccagagcatcatcgcctacaccatgagcttaggcgccgagaacagcgtggcctacagcaacaacagcatcgccatccccatcaacttcaccataagcgtgaccaccgagatcctgcctgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagaccccacccatcaaggacttcggcggcttcaacttcagccagatcctgcccgaccccagcaagcccagcaagcggagcttcatcgaggacctgctgttcaacaaggtgactctggccgacgccggcttcatcaagcagtacggcgattgcctgggggacatcgccgcccgggacctgatctgcgctcagaagttcaacggcctgaccgtgctgcctcccctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaacgacatcctggccaggctggacccacccgaggccgaggtgcagatcgaccggctgatcaccggccggctgcagagcctgcagacctacgtgacccagcagctgatccgggccgccgagattcgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacctacgtgcccgcccaggagaagaacttcacaaccgcccccgccatctgccacgacggcaaggcccacttcccccgggagggagtcttcgtgagcaacggcacccactggttcgtgacccagcggaacttctacgagccccagatcatcaccacccacaacaccttcgtgagcggcaactgcgacgtggtgatcggcatcgtgaacaacaccgtgtacgaccctctgcagcccgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccatggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23364 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4039: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23365 - RNA, 4030 nt, synthetic construct
  misc_feature 1..4030: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4030: mol_type = other RNA
aggagaaagcttaccatgttcgtgttcctggtgctgctgcccctggtgagcagccagtgcgtgaacttcaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgccaacccagtgctgcccttcaacgacggcgtgtacttcgccagcaccgagaagtcaaacatcatccggggctggatctttggcaccaccctggacagcaagacacagagcctgctgatcgtgaacaacgctaccaacgtggtgatcaaggtgtgcgagttccagttctgcaacgaccccttcctgggcgtgtactaccacaagaacaacaagagctggatggagagcgagttccgggtctacagcagcgccaacaattgcaccttcgagtacgtgagccagcccttcctgatggacctggagggcaagcagggcaacttcaagaacctccgggagttcgtgttcaagaacatcgacggctacttcaagatctacagcaagcacacccccatcaacctggtgcggggactgccccagggcttcagcgccctggagcctctggtggatctgcccatcggcatcaacatcaccaggttccagaccctgcacatcagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcacccttaagagcttcaccgtggagaagggcatctaccagaccagcaacttccgggtgcagcccactgagagcattgtgcggttccccaacatcaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctattccgtaagagcaacctgaagccatttgagcgggacatcagcaccgagatctaccaggccggtagcaccccctgcaacggcgtgaagggcttcaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggacatcgccgacaccaccgatgcagtgcgggacccccagaccctggagatcctggacatcaccccatgcagcttcggcggcgtgagcgtcatcacccccggaacaaacaccagcaaccaggtggccgtgctgtaccagggcgtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcctgggcgtggagaacagcgtggcctacagcaacaacagcatcgccatccctaccaacttcaccataagcgtgaccaccgagatcctgcccgtgagcatgaccaagaccagcgtggactgtaccatgtacatctgcggcgacagcaccgagtgcagcaacctgttactgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggggactgcctgggcgacatcgccgcccgggacctgatctgcgctcagaagttcaacggcctgaccgtgctgccccctctgctgaccgatgagatgatcgcccagtacaccagcgccctgctggccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaactttggcgccatcagctcagtgctgaatgacatcctgagccggctggatcccccagaggccgaggtgcagatcgacaggctgatcaccggccggctgcagagcctgcagacctacgtgacccagcagctgatccgggccgccgagattcgggccagcgccaacctggccgcaaccaagatgagcgagtgcgtgctgggccagagcaagcgggtggacttctgcggcaagggctaccacctgatgagcttcccccagagcgctccccacggcgtggtgttcctgcacgtcacatacgtgcccgcccaggagaagaacttcaccaccgcccccgccatctgccacgacggaaaggcccacttcccccgggagggcgtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctcgacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23366 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_K986P_V987P_E484K_D614G)
  source 1..4039: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23367 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4039: mol_type = other RNA
aggagaaagcttaccatgttcgtgttcctggtgctgctgcccctggtgagcagccagtgcgtgaacttcaccaaccggacccagctgcccagcgcctacaccaacagcttcacccggggcgtgtactaccctgacaaggtgttccggagcagcgtgctgcacagcacccaggacctgttcctgcccttcttcagcaacgtgacctggttccacgccatccacgtgagcggcaccaacggcaccaagcggttcgacaaccccgtgctgccattcaacgacggcgtgtacttcgccagcaccgagaagtcaaacatcatccggggctggatctttggcaccaccctggacagcaagacccagagcctgctgatcgtgaacaacgccacaaacgtggtgatcaaggtgtgcgagttccagttctgcaactaccccttcctgggcgtgtactaccacaagaacaacaagagctggatggagagcgagttccgggtctacagcagcgctaataactgcaccttcgagtacgtgagccagcccttcctgatggacctggagggcaagcagggcaacttcaagaacctcagcgagttcgtgttcaagaacatcgacggctacttcaagatctacagcaagcacacccccatcaacctggtgcgggatctgccccagggattcagcgccctggagcccctggtggacctgcctatcggcatcaacatcacccggttccagaccctgctggccctgcacaggagctacctgacccccggcgacagcagcagcggctggaccgccggcgccgccgcatactacgtgggctacctgcagccccggaccttcctgctgaagtacaacgagaacggcaccatcaccgacgccgtggactgcgccctggacccactgagcgagaccaagtgcaccctaaagagcttcaccgtggagaagggcatctaccagaccagcaacttccgggtgcagcccaccgagagcatcgtgcggttccccaacattactaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgctgacagcttcgtgatccggggcgacgaggtgcggcagatcgcccctggccagaccggcaccatcgccgactacaactacaagctgcccgacgacttcaccggctgcgtgatcgcctggaacagcaacaacctggacagcaaggtgggcggcaactacaactacctgtaccggctgttccgtaagagcaacctgaagccctttgagcgggacatcagcaccgagatctaccaggccggcagcaccccatgcaacggtgtgaagggcttcaactgctacttccccctgcagagctacggcttccagcccacctacggcgtgggctaccagccctaccgggtggtggtgctgagcttcgagctgctgcacgcccccgccaccgtgtgcggccccaaaaagagcaccaacctggtgaagaacaagtgcgtgaacttcaatttcaacggcctgaccggcaccggcgtgctgaccgagagcaacaagaagttcctgcctttccagcagttcggccgggacatcgccgataccaccgacgcagtgcgggacccccagaccctggagatcctggacatcaccccctgcagcttcggcggcgtgagcgtcatcaccccaggcacaaacaccagcaaccaggtggccgtgctgtaccagggagtgaactgcaccgaggtgcccgtggccatccacgccgaccagctgacccccacctggcgggtgtactccaccggcagcaacgtgttccagacccgggccggctgcctgatcggcgccgagtacgtgaacaacagctacgagtgcgacatccccatcggcgctggcatctgcgccagctaccagacccagaccaacagcccccggcgggcccggagcgtggccagccagagcatcatcgcctacaccatgagcctgggcgccgagaacagcgtggcctacagcaacaacagcatcgcgatccccaccaacttcaccatcagcgtgaccaccgagatattacctgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactccacccatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggacatcgccgctcgggatctgatctgcgcccagaagttcaacggcctgaccgtgctgcctcccctgctgaccgacgagatgatcgcccagtacaccagcgccctgctggccggcaccatcaccagcggctggaccttcggcgccggcgcagcccttcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagctcaaactttggcgccatcagcagcgtgctgaatgacatcctgagccggctggacccacccgaggccgaggtgcagatcgacaggctgatcaccggccggctgcagagcctgcagacctacgtgacccagcagctgatccgggccgccgagatccgggccagcgccaacctggcagccattaagatgagcgagtgcgtgctgggccagagcaagcgggtggacttctgcggcaagggctaccacctgatgagcttcccccagagcgctccccacggcgtggtgttcctgcacgtgacctacgtccccgcccaggagaagaacttcacaaccgcccccgccatctgccacgacggcaaggcccacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccctctccagcccgagctggacagcttcaaggaggagctggacaagtacttcaagaaccacaccagccccgacgtggacctgggcgatatcagcggcatcaacgccagcgtggtgaacatccagaaggagatcgaccggctgaacgaggtggccaagaacctgaacgagagcctgatcgacctgcaggagctgggcaagtacgagcagtacatcaagtggccatggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23368 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4039: mol_type = other RNA
aggagaaagcttaccatgttcgtgttcctggtgctgctgcccctggtgagcatccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctgcatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgtaccctaaagagcttcaccgtggagaagggcatctaccagaccagcaacttccgggtgcagcccactgagagcattgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactaccggtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgtgcctcctaccagacccagaccaacagcccccggcgggcccggagcgtggccagccagagcatcatcgcctacaccatgagcctgggcgccgagaacagcgtggcctacagcaacaacagcatcgcgatccctaccaacttcaccataagcgtgaccaccgagatcttacccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgctggccggcaccatcaccagcggctggaccttcggcgccggcgcagcccttcagatccccttcgccatgcagatggcctacaggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagcagcgtgctgaatgacatcctgtcacggctggatcccccagaggccgaggtgcagatcgaccggctgatcaccggccggctgcagagcctgcagacctacgtgacccagcagctgatccgggccgccgagattcgggccagcgccaacctggcagccaccaagatgagcgagtgcgtgctgggccagagcaagcgggtggacttttgcggcaagggctaccacctgatgagcttcccccagagcgctccccacggcgtggtgttcctgcacgtgacatacgtccccgcccaggagaagaacttcaccaccgcccccgccatctgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctccagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgttgcagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23369 - RNA, 4039 nt, synthetic construct; identical to SEQ ID NO: 165
  misc_feature 1..4039: note = SARS-CoV-2/Wuhan/WIV05/2019__EPI_ISL_402128 spike protein mRNA gc mod (1-1273)(K986P_V987P) R9519
  source 1..4039: mol_type = other RNA

SEQ ID NO: 23370 - RNA, 4039 nt, synthetic construct
  misc_feature 1..4039: note = SARS-CoV-2/Wuhan/WIV05/2019__EPI_ISL_402128 spike protein mRNA gc mod (1-1273)(K986P_V987P_ D614G)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23371 - RNA, 4039 nt, synthetic construct
  misc_feature 1..4039: note = SARS-CoV-2/Wuhan/WIV05/2019__EPI_ISL_402128 spike protein mRNA gc mod (1-1273)(K986P_V987P_A222V_D614G)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23372 - RNA, 4039 nt, synthetic construct
  misc_feature 1..4039: note = SARS-CoV-2/Wuhan/WIV05/2019__EPI_ISL_402128 spike protein mRNA gc mod (1-1273)(K986P_V987P_N439K_D614G)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23373 - RNA, 4039 nt, synthetic construct
  misc_feature 1..4039: note = SARS-CoV-2/Wuhan/WIV05/2019__EPI_ISL_402128 spike protein mRNA gc mod (1-1273)(K986P_V987P_S477N_D614G)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23374 - RNA, 4039 nt, synthetic construct
  misc_feature 1..4039: note = SARS-CoV-2/Wuhan/WIV05/2019__EPI_ISL_402128 spike protein mRNA gc mod (1-1273)(K986P_V987P_N501Y_D614G)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23375 - RNA, 4033 nt, synthetic construct
  misc_feature 1..4033: note = SARS-CoV-2/Wuhan/WIV05/2019__EPI_ISL_402128 spike protein mRNA gc mod (1-1273)(K986P_V987P_H69del_V70del_D614G)
  source 1..4033: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23376 - RNA, 4039 nt, synthetic construct
  misc_feature 1..4039: note = SARS-CoV-2/Wuhan/WIV05/2019__EPI_ISL_402128 spike protein mRNA gc mod (1-1273)(K986P_V987P_Y453F_D614G)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23377 - RNA, 4039 nt, synthetic construct
  misc_feature 1..4039: note = SARS-CoV-2/Wuhan/WIV05/2019__EPI_ISL_402128 spike protein mRNA gc mod (1-1273)(K986P_V987P_D614G_I692V)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23378 - RNA, 4039 nt, synthetic construct
  misc_feature 1..4039: note = SARS-CoV-2/Wuhan/WIV05/2019__EPI_ISL_402128 spike protein mRNA gc mod (1-1273)(K986P_V987P_D614G_M1229I)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23379 - RNA, 4033 nt, synthetic construct
  misc_feature 1..4033: note = SARS-CoV-2/Wuhan/WIV05/2019__EPI_ISL_402128 spike protein mRNA gc mod (1-1273)(K986P_V987P_H69del_V70del_A222V_Y453F_S477N_D614G_ I692V)
  source 1..4033: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23380 - RNA, 4033 nt, synthetic construct
  misc_feature 1..4033: note = SARS-CoV-2/Wuhan/WIV05/2019__EPI_ISL_402128 spike protein mRNA gc mod (1-1273)(K986P_V987P_H69del_V70del_Y453F_D614G_I692V_M1229I )
  source 1..4033: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23381 - RNA, 4030 nt, synthetic construct
  misc_feature 1..4030: note = SARS-CoV-2/Wuhan/WIV05/2019__EPI_ISL_402128 spike protein mRNA gc mod (1-1273)(K986P_V987P_K986P_V987P_H69del_V70del_Y144del_N501 Y_A570D_D614G_P681H_T716I_S982A_D1118H)
  source 1..4030: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccacagacgggctagaagcgtggccagccagagcatcattgcctacacaatgtctctgggcgccgagaacagcgtggcctactccaacaactctatcgctatccccatcaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23382 - RNA, 4039 nt, synthetic construct
  misc_feature 1..4039: note = SARS-CoV-2/Wuhan/WIV05/2019__EPI_ISL_402128 spike protein mRNA gc mod (1-1273)(K986P_V987P_K986P_V987P_K417N_E484K_N501Y_D614G)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23383 - RNA, 4030 nt, synthetic construct
  misc_feature 1..4030: note = SARS-CoV-2/Wuhan/WIV05/2019__EPI_ISL_402128 spike protein mRNA gc mod (1-1273)(K986P_V987P_K986P_V987P_L18F_D80A_D215G_L242del_A2 43del_L244del_R246I_K417N_E484K_N501Y_D614G_A701V)
  source 1..4030: mol_type = other RNA
aggagaaagcttaccatgttcgtgtttctggtgctgctgcccctggtgtccagccagtgtgtgaacttcaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgtggagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23384 - RNA, 4039 nt, synthetic construct
  misc_feature 1..4039: note = SARS-CoV-2/Wuhan/WIV05/2019__EPI_ISL_402128 spike protein mRNA gc mod (1-1273)(K986P_V987P_K986P_V987P_E484K_D614G)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23385 - RNA, 4039 nt, synthetic construct
  misc_feature 1..4039: note = SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S _K417T_E484K_N501Y_D614G_H655Y_T1027I)
  source 1..4039: mol_type = other RNA
aggagaaagcttaccatgttcgtgtttctggtgctgctgcccctggtgtccagccagtgtgtgaacttcaccaacagaacacagctgcctagcgcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23386 - RNA, 4039 nt, synthetic construct
  misc_feature 1..4039: note = SARS-CoV-2/Wuhan/WIV05/2019__EPI_ISL_402128 spike protein mRNA gc mod (1-1273)(K986P_V987P_K986P_V987P_S13I_W152C_L452R_D614G)
  source 1..4039: mol_type = other RNA
aggagaaagcttaccatgttcgtgtttctggtgctgctgcccctggtgtccatccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23387 - RNA, 4039 nt, synthetic construct
  misc_feature 1..4039: note = SARS-CoV-2/Wuhan/WIV05/2019__EPI_ISL_402128 spike protein mRNA gc mod (1-1273)(K986P_V987P)
  source 1..4039: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23388 - RNA, 4039 nt, synthetic construct
  misc_feature 1..4039: note = SARS-CoV-2/Wuhan/WIV05/2019__EPI_ISL_402128 spike protein mRNA gc mod (1-1273)(K986P_V987P_ D614G)
  source 1..4039: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23389 - RNA, 4039 nt, synthetic construct
  misc_feature 1..4039: note = SARS-CoV-2/Wuhan/WIV05/2019__EPI_ISL_402128 spike protein mRNA gc mod (1-1273)(K986P_V987P_A222V_D614G)
  source 1..4039: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23390 - RNA, 4039 nt, synthetic construct
  misc_feature 1..4039: note = SARS-CoV-2/Wuhan/WIV05/2019__EPI_ISL_402128 spike protein mRNA gc mod (1-1273)(K986P_V987P_N439K_D614G)
  source 1..4039: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23391 - RNA, 4039 nt, synthetic construct
  misc_feature 1..4039: note = SARS-CoV-2/Wuhan/WIV05/2019__EPI_ISL_402128 spike protein mRNA gc mod (1-1273)(K986P_V987P_S477N_D614G)
  source 1..4039: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23392 - RNA, 4039 nt, synthetic construct
  misc_feature 1..4039: note = SARS-CoV-2/Wuhan/WIV05/2019__EPI_ISL_402128 spike protein mRNA gc mod (1-1273)(K986P_V987P_N501Y_D614G)
  source 1..4039: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23393 - RNA, 4033 nt, synthetic construct
  misc_feature 1..4033: note = SARS-CoV-2/Wuhan/WIV05/2019__EPI_ISL_402128 spike protein mRNA gc mod (1-1273)(K986P_V987P_H69del_V70del_D614G)
  source 1..4033: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23394 - RNA, 4039 nt, synthetic construct
  misc_feature 1..4039: note = SARS-CoV-2/Wuhan/WIV05/2019__EPI_ISL_402128 spike protein mRNA gc mod (1-1273)(K986P_V987P_Y453F_D614G)
  source 1..4039: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23395 - RNA, 4039 nt, synthetic construct
  misc_feature 1..4039: note = SARS-CoV-2/Wuhan/WIV05/2019__EPI_ISL_402128 spike protein mRNA gc mod (1-1273)(K986P_V987P_D614G_I692V)
  source 1..4039: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23396 - RNA, 4039 nt, synthetic construct
  misc_feature 1..4039: note = SARS-CoV-2/Wuhan/WIV05/2019__EPI_ISL_402128 spike protein mRNA gc mod (1-1273)(K986P_V987P_D614G_M1229I)
  source 1..4039: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23397 - RNA, 4033 nt, synthetic construct
  misc_feature 1..4033: note = SARS-CoV-2/Wuhan/WIV05/2019__EPI_ISL_402128 spike protein mRNA gc mod (1-1273)(K986P_V987P_H69del_V70del_A222V_Y453F_S477N_D614G_ I692V)
  source 1..4033: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23398 - RNA, 4033 nt, synthetic construct
  misc_feature 1..4033: note = SARS-CoV-2/Wuhan/WIV05/2019__EPI_ISL_402128 spike protein mRNA gc mod (1-1273)(K986P_V987P_H69del_V70del_Y453F_D614G_I692V_M1229I )
  source 1..4033: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23399 - RNA, 4030 nt, synthetic construct
  misc_feature 1..4030: note = SARS-CoV-2/Wuhan/WIV05/2019__EPI_ISL_402128 spike protein mRNA gc mod (1-1273)(K986P_V987P_K986P_V987P_H69del_V70del_Y144del_N501 Y_A570D_D614G_P681H_T716I_S982A_D1118H)
  source 1..4030: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccaccggagagccagaagcgtggccagccagagcatcattgcctacacaatgtctctgggcgccgagaacagcgtggcctactccaacaactctatcgctatccccatcaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23400 - RNA, 4039 nt, synthetic construct
  misc_feature 1..4039: note = SARS-CoV-2/Wuhan/WIV05/2019__EPI_ISL_402128 spike protein mRNA gc mod (1-1273)(K986P_V987P_K986P_V987P_K417N_E484K_N501Y_D614G)
  source 1..4039: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23401 - RNA, 4030 nt, synthetic construct
  misc_feature 1..4030: note = SARS-CoV-2/Wuhan/WIV05/2019__EPI_ISL_402128 spike protein mRNA gc mod (1-1273)(K986P_V987P_K986P_V987P_L18F_D80A_D215G_L242del_A2 43del_L244del_R246I_K417N_E484K_N501Y_D614G_A701V)
  source 1..4030: mol_type = other RNA
aggagaaagcttaccatgttcgtgttcctggtgctgctgcctctggtgtccagccagtgtgtgaacttcaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgtggagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23402 - RNA, 4039 nt, synthetic construct
  misc_feature 1..4039: note = SARS-CoV-2/Wuhan/WIV05/2019__EPI_ISL_402128 spike protein mRNA gc mod (1-1273)(K986P_V987P_K986P_V987P_E484K_D614G)
  source 1..4039: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23403 - RNA, 4039 nt, synthetic construct
  misc_feature 1..4039: note = SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S _K417T_E484K_N501Y_D614G_H655Y_T1027I)
  source 1..4039: mol_type = other RNA
aggagaaagcttaccatgttcgtgttcctggtgctgctgcctctggtgtccagccagtgtgtgaacttcaccaacagaacacagctgcctagcgcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23404 - RNA, 4039 nt, synthetic construct
  misc_feature 1..4039: note = SARS-CoV-2/Wuhan/WIV05/2019__EPI_ISL_402128 spike protein mRNA gc mod (1-1273)(K986P_V987P_K986P_V987P_S13I_W152C_L452R_D614G)
  source 1..4039: mol_type = other RNA
aggagaaagcttaccatgttcgtgttcctggtgctgctgcctctggtgtccatccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23405 - RNA, 1424 nt, synthetic construct; identical to SEQ ID NO: 22787
  misc_feature 1..1424: note = SARS-CoV-2/Wuhan/WIV05/2019__EPI_ISL_402128 spike protein mRNA gc (1-15,334-528) Ferritin construct R10340
  source 1..1424: mol_type = other RNA

SEQ ID NO: 23406 - RNA, 1022 nt, synthetic construct; identical to SEQ ID NO: 22788
  misc_feature 1..1022: note = SARS-CoV-2/Wuhan/WIV05/2019__EPI_ISL_402128 spike protein mRNA gc (334-528) Foldon construct R9927
  source 1..1022: mol_type = other RNA

SEQ ID NO: 23407 - RNA, 1400 nt, synthetic construct; identical to SEQ ID NO: 22789
  misc_feature 1..1400: note = SARS-CoV-2/Wuhan/WIV05/2019__EPI_ISL_402128 spike protein mRNA gc (1-15,334-528) LumSynth construct R10338
  source 1..1400: mol_type = other RNA

SEQ ID NO: 23408 - RNA, 1361 nt, synthetic construct; identical to SEQ ID NO: 22790
  misc_feature 1..1361: note = SARS-CoV-2/Wuhan/WIV05/2019__EPI_ISL_402128 spike protein mRNA gc (334-528) LumSynth construct R10339
  source 1..1361: mol_type = other RNA

SEQ ID NO: 23409 - RNA, 4094 nt, synthetic construct; identical to SEQ ID NO: 148
  misc_feature 1..4094: note = SARS-CoV-2/Wuhan/WIV05/2019__EPI_ISL_402128 spike protein mRNA gc (1-1273) R9488, R9492, R10161
  source 1..4094: mol_type = other RNA

SEQ ID NO: 23410 - RNA, 4094 nt, synthetic construct; identical to SEQ ID NO: 22791
  misc_feature 1..4094: note = SARS-CoV-2/Wuhan/WIV05/2019__EPI_ISL_402128 spike protein mRNA gc (1-1273)(D614G) R10182
  source 1..4094: mol_type = other RNA

SEQ ID NO: 23411 - RNA, 4094 nt, synthetic construct; identical to SEQ ID NO: 22793
  misc_feature 1..4094: note = SARS-CoV-2/Wuhan/WIV05/2019__EPI_ISL_402128 spike protein mRNA gc (1-1273)(A222V_D614G) R10278
  source 1..4094: mol_type = other RNA

SEQ ID NO: 23412 - RNA, 4094 nt, synthetic construct; identical to SEQ ID NO: 22795
  misc_feature 1..4094: note = SARS-CoV-2/Wuhan/WIV05/2019__EPI_ISL_402128 spike protein mRNA gc (1-1273)(N439K_D614G) R10298
  source 1..4094: mol_type = other RNA

SEQ ID NO: 23413 - RNA, 4094 nt, synthetic construct; identical to SEQ ID NO: 22797
  misc_feature 1..4094: note = SARS-CoV-2/Wuhan/WIV05/2019__EPI_ISL_402128 spike protein mRNA gc (1-1273)(S477N_D614G) R10287
  source 1..4094: mol_type = other RNA

SEQ ID NO: 23414 - RNA, 4094 nt, synthetic construct; identical to SEQ ID NO: 22799
  misc_feature 1..4094: note = SARS-CoV-2/Wuhan/WIV05/2019__EPI_ISL_402128 spike protein mRNA gc (1-1273)(N501Y_D614G)
  source 1..4094: mol_type = other RNA

SEQ ID NO: 23415 - RNA, 4088 nt, synthetic construct; identical to SEQ ID NO: 22801
  misc_feature 1..4088: note = SARS-CoV-2/Wuhan/WIV05/2019__EPI_ISL_402128 spike protein mRNA gc (1-1273)(H69del_V70del_D614G) R10274
  source 1..4088: mol_type = other RNA

SEQ ID NO: 23416 - RNA, 4094 nt, synthetic construct; identical to SEQ ID NO: 22803
  misc_feature 1..4094: note = SARS-CoV-2/Wuhan/WIV05/2019__EPI_ISL_402128 spike protein mRNA gc (1-1273)(Y453F_D614G) R10282
  source 1..4094: mol_type = other RNA

SEQ ID NO: 23417 - RNA, 4094 nt, synthetic construct; identical to SEQ ID NO: 22805
  misc_feature 1..4094: note = SARS-CoV-2/Wuhan/WIV05/2019__EPI_ISL_402128 spike protein mRNA gc (1-1273)(D614G_I692V) R10290
  source 1..4094: mol_type = other RNA

SEQ ID NO: 23418 - RNA, 4094 nt, synthetic construct; identical to SEQ ID NO: 22807
  misc_feature 1..4094: note = SARS-CoV-2/Wuhan/WIV05/2019__EPI_ISL_402128 spike protein mRNA gc (1-1273)(D614G_M1229I)
  source 1..4094: mol_type = other RNA

SEQ ID NO: 23419 - RNA, 4088 nt, synthetic construct; identical to SEQ ID NO: 22809
  misc_feature 1..4088: note = SARS-CoV-2/Wuhan/WIV05/2019__EPI_ISL_402128 spike protein mRNA gc (1-1273)(H69del_V70del_A222V_Y453F_S477N_D614G_I692V) R10294
  source 1..4088: mol_type = other RNA

SEQ ID NO: 23420 - RNA, 4088 nt, synthetic construct; identical to SEQ ID NO: 22811
  misc_feature 1..4088: note = SARS-CoV-2/Wuhan/WIV05/2019__EPI_ISL_402128 spike protein mRNA gc (1-1273)(H69del_V70del_Y453F_D614G_I692V_M1229I)
  source 1..4088: mol_type = other RNA

SEQ ID NO: 23421 - RNA, 4085 nt, synthetic construct
  misc_feature 1..4085: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H) R10356
  source 1..4085: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgacgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactcccaccggcgcgcccggagcgtggcgtcccagagcatcatcgcctacaccatgtccctgggcgccgagaacagcgtcgcctactccaacaacagcatcgccatccccatcaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctcgcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccacccacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23422 - RNA, 4094 nt, synthetic construct
  misc_feature 1..4094: note = SARS-CoV-2/Wuhan/WIV05/2019__EPI_ISL_402128 spike protein mRNA gc (1-1273)(K417N_E484K_N501Y_D614G) R10359
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23423 - RNA, 4085 nt, synthetic construct
  misc_feature 1..4085: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4085: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacttcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgccaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccggggcctgccccaggggttcagcgccctcgagcccctggtggacctgcccatcggcatcaacatcacccgcttccagaccctccacatctcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgtggagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23424 - RNA, 4094 nt, synthetic construct
  misc_feature 1..4094: note = SARS-CoV-2/Wuhan/WIV05/2019__EPI_ISL_402128 spike protein mRNA gc (1-1273)(E484K_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23425 - RNA, 4094 nt, synthetic construct
  misc_feature 1..4094: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacttcaccaaccgcacgcagctgccgagcgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaactaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctcagcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaccatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgatcaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23426 - RNA, 4094 nt, synthetic construct
  misc_feature 1..4094: note = SARS-CoV-2/Wuhan/WIV05/2019__EPI_ISL_402128 spike protein mRNA gc (1-1273)(S13I_W152C_L452R_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagcatccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctgcatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactaccgctaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23427 - RNA, 4094 nt, synthetic construct; identical to SEQ ID NO: 148
  misc_feature 1..4094: note = SARS-CoV-2/Wuhan/WIV05/2019__EPI_ISL_402128 spike protein mRNA gc (1-1273) R9488, R9492, R10161
  source 1..4094: mol_type = other RNA

SEQ ID NO: 23428 - RNA, 4094 nt, synthetic construct; identical to SEQ ID NO: 12279
  misc_feature 1..4094: note = SARS-CoV-2/Wuhan/WIV05/2019__EPI_ISL_402128 spike protein mRNA gc (1-1273)(D614G)
  source 1..4094: mol_type = other RNA

SEQ ID NO: 23429 - RNA, 4094 nt, synthetic construct
  misc_feature 1..4094: note = SARS-CoV-2/Wuhan/WIV05/2019__EPI_ISL_402128 spike protein mRNA gc (1-1273)(A222V_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtgctcgagcccctggtggacctgcccatcggcatcaacatcacccgcttccagaccctcctggccctgcaccggtcctacctcacgccgggggacagcagctccggctggaccgccggcgcggccgcctactacgtcgggtacctgcagccccgcaccttcctgctcaagtacaacgagaacggcaccatcacggacgccgtggactgcgcgctggaccccctgagcgagaccaagtgcaccctcaagtccttcaccgtggagaaggggatctaccagacgagcaacttccgggtccagcccaccgagtccatcgtgcgcttcccgaacatcaccaacctgtgccccttcggcgaggtcttcaacgccacccggttcgccagcgtgtacgcctggaaccgcaagcggatctccaactgcgtggccgactacagcgtcctgtacaactccgcgagcttctccacgttcaagtgctacggcgtgagccccaccaagctcaacgacctgtgcttcaccaacgtgtacgccgactccttcgtcatccgcggggacgaggtgcggcagatcgcccccggccagaccgggaagatcgccgactacaactacaagctgccggacgacttcacgggctgcgtgatcgcctggaacagcaacaacctcgactccaaggtcgggggcaactacaactacctgtaccgcctgttccgcaagagcaacctcaagcccttcgagcgggacatctccaccgagatctaccaggcgggcagcaccccctgcaacggggtggagggcttcaactgctacttccccctgcagtcctacgggttccagccgaccaacggcgtggggtaccagccctaccgggtcgtggtgctgagcttcgagctcctgcacgcccccgccacggtctgcggccccaagaagtccaccaacctggtgaagaacaagtgcgtgaacttcaacttcaacggcctcaccgggaccggcgtcctgaccgagagcaacaagaagttcctgccgttccagcagttcgggcgcgacatcgccgacacgaccgacgccgtgcgcgacccccagaccctggagatcctcgacatcaccccctgcagcttcggcggggtgtccgtcatcacgccgggcaccaacaccagcaaccaggtggcggtgctgtaccagggcgtcaactgcaccgaggtgcccgtggccatccacgccgaccagctgacgcccacctggcgggtctactccaccgggagcaacgtgttccagacccgcgccggctgcctcatcggggccgagcacgtgaacaactcctacgagtgcgacatccccatcggcgcgggcatctgcgccagctaccagacgcagaccaactccccgcggcgcgcccggagcgtcgcctcccagagcatcatcgcgtacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgccctgacgggcatcgcggtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggccgcggagatccgcgccagcgccaacctcgccgccaccaagatgtccgagtgcgtgctgggccagagcaagcgggtggacttctgcgggaagggctaccacctgatgtccttcccccagagcgcgccgcacggggtcgtgttcctccacgtcacgtacgtgcccgcccaggagaagaacttcaccaccgcccccgccatctgccacgacggcaaggcgcacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgccatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23430 - RNA, 4094 nt, synthetic construct
  misc_feature 1..4094: note = SARS-CoV-2/Wuhan/WIV05/2019__EPI_ISL_402128 spike protein mRNA gc (1-1273)(N439K_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23431 - RNA, 4094 nt, synthetic construct
  misc_feature 1..4094: note = SARS-CoV-2/Wuhan/WIV05/2019__EPI_ISL_402128 spike protein mRNA gc (1-1273)(S477N_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgagcgtgatcacgccgggcaccaacacctccaaccaggtcgccgtgctgtaccagggcgtgaactgcaccgaggtccccgtggccatccacgccgaccagctgacgcccacctggcgggtgtacagcaccgggtccaacgtcttccagacccgcgccggctgcctcatcggggcggagcacgtgaacaacagctacgagtgcgacatccccatcggcgccggcatctgcgcctcctaccagacgcagaccaacagcccgcggcgcgcccggtccgtggcgagccagtccatcatcgcctacaccatgagcctgggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctcctgctgcagtacgggagcttctgcacccagctcaaccgcgcgctgacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacacctccgccctcctggcgggcaccatcacgagcgggtggaccttcggcgccggcgccgccctgcagatccccttcgcgatgcagatggcctaccggttcaacgggatcggcgtcacccagaacgtgctctacgagaaccagaagctgatcgccaaccagttcaactccgccatcgggaagatccaggacagcctgtccagcaccgcctccgcgctcggcaagctgcaggacgtggtcaaccagaacgcccaggccctgaacacgctcgtgaagcagctgagctccaacttcggggccatcagctccgtgctgaacgacatcctcagccgcctggacaaggtcgaggccgaggtgcagatcgaccggctgatcaccggccgcctccagtccctgcagacctacgtgacccagcagctgatccgggcggccgagatccgcgccagcgccaacctcgccgcgaccaagatgagcgagtgcgtcctgggccagtccaagcgggtggacttctgcgggaagggctaccacctgatgagcttcccccagtccgccccgcacggggtggtcttcctccacgtgacgtacgtccccgcccaggagaagaacttcaccaccgcccccgcgatctgccacgacggcaaggcccacttcccccgcgagggggtgttcgtgagcaacggcacccactggttcgtcacgcagcggaacttctacgagccgcagatcatcaccaccgacaacaccttcgtgtccggcaactgcgacgtggtcatcgggatcgtgaacaacacggtgtacgaccccctgcagcccgagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccgtggtacatctggctgggcttcatcgccgggctgatcgcgatcgtgatggtgaccatcatgctctgctgcatgacctcctgctgcagctgcctgaagggctgctgctcctgcgggagctgctgcaagttcgacgaggacgactccgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23432 - RNA, 4094 nt, synthetic construct
  misc_feature 1..4094: note = SARS-CoV-2/Wuhan/WIV05/2019__EPI_ISL_402128 spike protein mRNA gc (1-1273)(N501Y_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23433 - RNA, 4088 nt, synthetic construct
  misc_feature 1..4088: note = SARS-CoV-2/Wuhan/WIV05/2019__EPI_ISL_402128 spike protein mRNA gc (1-1273)(H69del_V70del_D614G)
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtggcctactccaacaacagcatcgccatccccaccaacttcacgatctccgtcaccaccgagatcctgcccgtgagcatgaccaagacgagcgtggactgcaccatgtacatctgcggcgactccaccgagtgcagcaacctcctgctgcagtacgggtccttctgcacccagctcaaccgcgcgctgacgggcatcgccgtcgagcaggacaagaacacccaggaggtgttcgcccaggtgaagcagatctacaagacgcccccgatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtcctctacgagaaccagaagctgatcgccaaccagttcaacagcgccatcgggaagatccaggactccctgagctccaccgccagcgcgctcggcaagctgcaggacgtggtgaaccagaacgcccaggccctgaacacgctcgtcaagcagctgtccagcaacttcggggccatctccagcgtgctgaacgacatcctctcccgcctggacaaggtggaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgccccgcacggggtggtgttcctccacgtcacgtacgtgcccgcccaggagaagaacttcaccaccgcccccgcgatctgccacgacggcaaggcccacttcccccgcgagggggtcttcgtgtccaacggcacccactggttcgtgacgcagcggaacttctacgagccgcagatcatcaccaccgacaacaccttcgtcagcggcaactgcgacgtggtgatcgggatcgtcaacaacacggtgtacgaccccctgcagcccgagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagcccgtgctgaagggcgtcaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23434 - RNA, 4094 nt, synthetic construct
  misc_feature 1..4094: note = SARS-CoV-2/Wuhan/WIV05/2019__EPI_ISL_402128 spike protein mRNA gc (1-1273)(Y453F_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23435 - RNA, 4094 nt, synthetic construct
  misc_feature 1..4094: note = SARS-CoV-2/Wuhan/WIV05/2019__EPI_ISL_402128 spike protein mRNA gc (1-1273)(D614G_I692V)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcgtcatcgcctacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgcgctgacgggcatcgccgtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtcctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtgctctacgagaaccagaagctgatcgccaaccagttcaacagcgccatcgggaagatccaggactccctgagctccaccgccagcgcgctcggcaagctgcaggacgtcgtgaaccagaacgcccaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggcggccgagatccgcgccagcgccaacctcgccgcgaccaagatgtccgagtgcgtgctgggccagagcaagcgggtggacttctgcgggaagggctaccacctgatgtccttcccccagagcgccccgcacggggtcgtgttcctccacgtcacgtacgtgcccgcccaggagaagaacttcaccaccgcccccgcgatctgccacgacggcaaggcccacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgcgatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23436 - RNA, 4094 nt, synthetic construct; identical to SEQ ID NO: 12324
  misc_feature 1..4094: note = SARS-CoV-2/Wuhan/WIV05/2019__EPI_ISL_402128 spike protein mRNA gc (1-1273)(D614G_M1229I)
  source 1..4094: mol_type = other RNA

SEQ ID NO: 23437 - RNA, 4088 nt, synthetic construct
  misc_feature 1..4088: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgtcctcgagcccctggtggacctgcccatcggcatcaacatcacccgcttccagaccctcctggccctgcaccggtcctacctcacgccgggggacagcagctccggctggaccgccggcgcggccgcctactacgtggggtacctgcagccccgcaccttcctgctcaagtacaacgagaacggcaccatcacggacgccgtcgactgcgcgctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggccgactacagcgtgctgtacaactccgcgagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcctggaacagcaacaacctcgactccaaggtcgggggcaactacaactacctgttccgcctgttccgcaagagcaacctcaagcccttcgagcgggacatctccaccgagatctaccaggcgggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgccgtccgcgacccccagaccctggagatcctcgacatcaccccctgcagcttcggcggggtgagcgtgatcacgccgggcaccaacacctccaaccaggtcgcggtgctgtaccagggcgtgaactgcaccgaggtccccgtggccatccacgccgaccagctgacgcccacctggcgggtgtacagcaccgggtccaacgtcttccagacccgcgccggctgcctcatcggggccgagcacgtgaacaacagctacgagtgcgacatccccatcggcgcgggcatctgcgcctcctaccagacgcagaccaacagcccgcggcgcgcccggtccgtggccagccagtccgtcatcgcgtacaccatgagcctgggggccgagaactccgtggcctacagcaacaactccatcgccatccccaccaacttcacgatcagcgtgaccaccgagatcctgcccgtctccatgaccaagacgagcgtggactgcaccatgtacatctgcggcgacagcaccgagtgctccaacctcctgctgcagtacgggagcttctgcacccagctcaaccgcgccctgacgggcatcgcggtggagcaggacaagaacacccaggaggtcttcgcccaggtgaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacacctccgccctcctggccggcaccatcacgagcgggtggaccttcggcgcgggcgccgccctgcagatccccttcgccatgcagatggcgtaccggttcaacgggatcggcgtgacccagaacgtgctctacgagaaccagaagctgatcgccaaccagttcaactccgccatcgggaagatccaggacagcctgtccagcaccgcctccgccctcggcaagctgcaggacgtcgtgaaccagaacgcgcaggccctgaacacgctcgtgaagcagctgagctccaacttcggggccatcagctccgtcctgaacgacatcctcagccgcctggacaaggtggaggccgaggtgcagatcgaccggctgatcaccggccgcctccagtccctgcagacctacgtcacccagcagctgatccgggccgcggagatccgcgccagcgccaacctcgccgccaccaagatgagcgagtgcgtgctgggccagtccaagcgggtggacttctgcgggaagggctaccacctgatgagcttcccccagtccgcgccgcacggggtcgtgttcctccacgtcacgtacgtgcccgcccaggagaagaacttcaccaccgcccccgccatctgccacgacggcaaggcgcacttcccccgcgagggggtgttcgtcagcaacggcacccactggttcgtgacgcagcggaacttctacgagccgcagatcatcaccaccgacaacaccttcgtgtccggcaactgcgacgtcgtgatcgggatcgtgaacaacacggtctacgaccccctgcagcccgagctggacagcttcaaggaggagctcgacaagtacttcaagaaccacacctcccccgacgtggacctgggcgacatcagcgggatcaacgcctccgtggtcaacatccagaaggagatcgaccgcctgaacgaggtggccaagaacctcaacgagagcctgatcgacctgcaggagctcggcaagtacgagcagtacatcaagtggccgtggtacatctggctgggcttcatcgccgggctgatcgccatcgtgatggtcaccatcatgctctgctgcatgacctcctgctgcagctgcctgaagggctgctgctcctgcgggagctgctgcaagttcgacgaggacgactccgagcccgtgctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23438 - RNA, 4088 nt, synthetic construct
  misc_feature 1..4088: note = SARS-CoV-2/Wuhan/WIV05/2019__EPI_ISL_402128 spike protein mRNA gc (1-1273)(H69del_V70del_Y453F_D614G_I692V_M1229I)
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcgtgatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatcgtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23439 - RNA, 4085 nt, synthetic construct
  misc_feature 1..4085: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4085: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgacgacacgaccgacgccgtgcgcgacccccagaccctggagatcctcgacatcaccccctgcagcttcggcggggtctccgtgatcacgccgggcaccaacaccagcaaccaggtggcggtcctgtaccagggcgtgaactgcaccgaggtgcccgtcgccatccacgccgaccagctgacgcccacctggcgggtgtactccaccgggagcaacgtgttccagacccgcgccggctgcctcatcggggccgagcacgtcaacaactcctacgagtgcgacatccccatcggcgcgggcatctgcgccagctaccagacgcagaccaactcccaccggcgcgcccggagcgtggcctcccagagcatcatcgcgtacaccatgtccctgggggccgagaacagcgtggcctactccaacaacagcatcgccatcccgatcaacttcaccatctccgtcacgaccgagatcctgcccgtgagcatgaccaagaccagcgtggactgcacgatgtacatctgcggcgactccaccgagtgcagcaacctcctgctgcagtacgggtccttctgcacccagctcaaccgcgccctgaccggcatcgcggtcgagcaggacaagaacacgcaggaggtgttcgcccaggtgaagcagatctacaagaccccgcccatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgccgcgcgcgacctgatctgcgcccagaagttcaacgggctgaccgtgctgcccccgctcctgacggacgagatgatcgcccagtacaccagcgccctcctggccggcaccatcacctccgggtggacgttcggcgcgggcgccgccctgcagatccccttcgccatgcagatggcgtaccggttcaacgggatcggcgtgacccagaacgtcctctacgagaaccagaagctgatcgccaaccagttcaacagcgccatcgggaagatccaggactccctgagctccaccgccagcgccctcggcaagctgcaggacgtggtgaaccagaacgcgcaggccctgaacaccctcgtcaagcagctgtccagcaacttcggggccatctccagcgtgctgaacgacatcctcgcccgcctggacaaggtggaggccgaggtccagatcgaccggctgatcacgggccgcctccagtccctgcagacctacgtgacccagcagctgatccgggcggccgagatccgcgccagcgccaacctcgccgcgaccaagatgagcgagtgcgtgctgggccagtccaagcgggtcgacttctgcgggaagggctaccacctgatgagcttcccccagtccgcgccccacggggtggtgttcctccacgtcacctacgtgccggcccaggagaagaacttcacgaccgcccccgccatctgccacgacggcaaggcccacttcccccgcgagggggtcttcgtgagcaacggcacccactggttcgtgacccagcggaacttctacgagccccagatcatcacgacccacaacaccttcgtctccggcaactgcgacgtggtgatcgggatcgtcaacaacaccgtgtacgacccgctgcagcccgagctggacagcttcaaggaggagctcgacaagtacttcaagaaccacacgtcccccgacgtggacctgggcgacatcagcgggatcaacgcctccgtcgtgaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtcatggtgaccatcatgctctgctgcatgacctcctgctgcagctgcctgaagggctgctgctcctgcgggagctgctgcaagttcgacgaggacgactccgagccggtgctgaagggcgtcaagctccactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23440 - RNA, 4094 nt, synthetic construct
  misc_feature 1..4094: note = SARS-CoV-2/Wuhan/WIV05/2019__EPI_ISL_402128 spike protein mRNA gc (1-1273)(K417N_E484K_N501Y_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23441 - RNA, 4085 nt, synthetic construct
  misc_feature 1..4085: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4085: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacttcaccacccgcacgcagctcccgcccgcctacaccaacagcttcacccggggcgtctactaccccgacaaggtgttccgctccagcgtgctgcactccacccaggacctgttcctccccttcttcagcaacgtcacgtggttccacgccatccacgtgtccgggaccaacggcaccaagcggttcgcgaacccggtgctgcccttcaacgacggggtctacttcgccagcaccgagaagtccaacatcatccgcggctggatcttcgggacgaccctggacagcaagacccagtccctcctgatcgtgaacaacgccaccaacgtggtcatcaaggtgtgcgagttccagttctgcaacgaccccttcctgggcgtgtactaccacaagaacaacaagagctggatggagtccgagttccgggtctacagctccgccaacaactgcacgttcgagtacgtgagccagcccttcctcatggacctggagggcaagcaggggaacttcaagaacctgcgcgagttcgtgttcaagaacatcgacggctacttcaagatctactccaagcacaccccgatcaacctcgtccgggggctgccccagggcttcagcgccctggagcccctcgtggacctgcccatcgggatcaacatcacccgcttccagaccctgcacatctcctacctcacgccgggcgacagcagctccggctggaccgcgggggccgccgcctactacgtgggctacctgcagccccggaccttcctgctcaagtacaacgagaacgggaccatcacggacgcggtcgactgcgccctggaccccctgagcgagaccaagtgcaccctcaagtccttcaccgtggagaagggcatctaccagacgagcaacttccgcgtgcagcccaccgagtccatcgtccggttcccgaacatcaccaacctgtgccccttcggcgaggtgttcaacgccacccgcttcgccagcgtctacgcctggaaccggaagcgcatctccaactgcgtggcggactacagcgtgctgtacaactccgccagcttctccacgttcaagtgctacggggtcagccccaccaagctcaacgacctgtgcttcaccaacgtgtacgccgactccttcgtgatccggggcgacgaggtccgccagatcgcccccgggcagaccggcaacatcgccgactacaactacaagctgccggacgacttcacggggtgcgtgatcgcgtggaacagcaacaacctcgactccaaggtgggcggcaactacaactacctgtaccggctgttccgcaagagcaacctcaagcccttcgagcgggacatctccaccgagatctaccaggccgggagcaccccctgcaacggcgtcaaggggttcaactgctacttccccctgcagtcctacggcttccagccgacctacggggtgggctaccagccctaccgcgtggtcgtgctgagcttcgagctcctgcacgcccccgccacggtgtgcggccccaagaagtccaccaacctggtcaagaacaagtgcgtgaacttcaacttcaacgggctcaccggcaccggggtgctgaccgagagcaacaagaagttcctgccgttccagcagttcggccgggacatcgccgacacgaccgacgcggtccgcgacccccagaccctcgagatcctggacatcaccccctgcagcttcgggggcgtgtccgtgatcacgccgggcaccaacaccagcaaccaggtcgccgtgctgtaccagggggtgaactgcaccgaggtccccgtggccatccacgccgaccagctgacgcccacctggcgcgtgtactccaccggcagcaacgtcttccagacccgggccgggtgcctcatcggcgcggagcacgtgaacaactcctacgagtgcgacatccccatcggcgccgggatctgcgccagctaccagacgcagaccaactccccgcgccgggcccgcagcgtggcgtcccagagcatcatcgcctacaccatgtccctgggcgtcgagaacagcgtggcctactccaacaacagcatcgccatccccaccaacttcacgatctccgtgaccaccgagatcctgcccgtcagcatgaccaagacgagcgtggactgcaccatgtacatctgcggggactccaccgagtgcagcaacctcctgctgcagtacggctccttctgcacccagctcaaccgggccctgacggggatcgcggtggagcaggacaagaacacccaggaggtcttcgcccaggtgaagcagatctacaagacgcccccgatcaaggacttcggcggcttcaacttcagccagatcctgcccgacccctccaagcccagcaagcgctccttcatcgaggacctcctgttcaacaaggtgaccctggccgacgccgggttcatcaagcagtacggcgactgcctcggggacatcgccgcgcgggacctgatctgcgcccagaagttcaacggcctgaccgtcctcccgcccctgctgaccgacgagatgatcgcccagtacaccagcgccctcctggccgggaccatcacgtccggctggaccttcggcgcgggggccgccctgcagatccccttcgccatgcagatggcgtaccgcttcaacggcatcggggtgacccagaacgtgctctacgagaaccagaagctgatcgccaaccagttcaacagcgccatcggcaagatccaggactccctgagctccaccgccagcgccctcgggaagctgcaggacgtcgtgaaccagaacgcgcaggccctgaacacgctcgtgaagcagctgtccagcaacttcggcgccatctccagcgtcctgaacgacatcctctcccggctggacaaggtggaggccgaggtgcagatcgaccgcctgatcaccggccggctccagagcctgcagacctacgtcacccagcagctgatccgcgccgcggagatccgggccagcgccaacctcgccgccaccaagatgtccgagtgcgtgctggggcagagcaagcgcgtggacttctgcggcaaggggtaccacctgatgtccttcccccagagcgcgccgcacggcgtcgtgttcctccacgtcacgtacgtgcccgcccaggagaagaacttcaccaccgcccccgccatctgccacgacgggaaggcgcacttcccccgggagggcgtgttcgtctccaacggcacccactggttcgtgacgcagcgcaacttctacgagccgcagatcatcaccaccgacaacaccttcgtgagcgggaactgcgacgtcgtgatcggcatcgtgaacaacacggtctacgaccccctgcagcccgagctggactccttcaaggaggagctcgacaagtacttcaagaaccacaccagccccgacgtggacctgggggacatctccggcatcaacgccagcgtggtcaacatccagaaggagatcgaccggctgaacgaggtggccaagaacctcaacgagtccctgatcgacctgcaggagctcggcaagtacgagcagtacatcaagtggccgtggtacatctggctggggttcatcgccggcctgatcgccatcgtgatggtcaccatcatgctctgctgcatgaccagctgctgctcctgcctgaaggggtgctgcagctgcggctcctgctgcaagttcgacgaggacgacagcgagcccgtgctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23442 - RNA, 4094 nt, synthetic construct
  misc_feature 1..4094: note = SARS-CoV-2/Wuhan/WIV05/2019__EPI_ISL_402128 spike protein mRNA gc (1-1273)(E484K_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23443 - RNA, 4094 nt, synthetic construct
  misc_feature 1..4094: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacttcaccaaccgcacccagctcccgagcgcctacacgaactccttcacccggggcgtctactaccccgacaaggtgttccgcagctccgtgctgcacagcacccaggacctgttcctccccttcttctccaacgtcacctggttccacgccatccacgtgagcgggacgaacggcaccaagcggttcgacaaccccgtgctgccgttcaacgacggggtctacttcgcgtccaccgagaagtccaacatcatccgcggctggatcttcgggaccacgctggactccaagacccagagcctcctgatcgtgaacaacgccaccaacgtggtcatcaaggtgtgcgagttccagttctgcaactaccccttcctgggcgtgtactaccacaagaacaacaagtcctggatggagagcgagttccgggtctactccagcgccaacaactgcaccttcgagtacgtgtcccagcccttcctcatggacctggagggcaagcaggggaacttcaagaacctgagcgagttcgtgttcaagaacatcgacggctacttcaagatctactccaagcacacgcccatcaacctcgtccgcgacctgccgcaggggttcagcgccctggagcccctcgtggacctgcccatcggcatcaacatcacccggttccagaccctgctcgccctgcaccgcagctacctgacccccggggactccagctccggctggacggcgggcgccgccgcctactacgtggggtacctccagccgcggaccttcctgctgaagtacaacgagaacggcaccatcaccgacgcggtcgactgcgccctcgaccccctgagcgagacgaagtgcaccctgaagtccttcaccgtggagaaggggatctaccagaccagcaacttccgcgtgcagcccacggagtccatcgtccggttccccaacatcaccaacctctgcccgttcggcgaggtgttcaacgccacccgcttcgccagcgtctacgcctggaaccggaagcgcatctccaactgcgtggcggactacagcgtgctgtacaactccgccagcttctccaccttcaagtgctacggcgtcagccccacgaagctgaacgacctctgcttcaccaacgtgtacgccgactccttcgtgatccgcggggacgaggtccggcagatcgcccccggccagaccgggaccatcgccgactacaactacaagctgcccgacgacttcacgggctgcgtgatcgcgtggaacagcaacaacctggactccaaggtcgggggcaactacaactacctctaccggctgttccgcaagagcaacctgaagccgttcgagcgggacatctccaccgagatctaccaggccggcagcaccccctgcaacggggtgaagggcttcaactgctacttccccctccagagctacgggttccagcccacctacggcgtggggtaccagccgtaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgcccttccagcagttcgggcgggacatcgccgacacgaccgacgcggtccgcgacccgcagaccctggagatcctggacatcaccccctgcagcttcggcggggtgtccgtgatcacgcccggcaccaacaccagcaaccaggtcgccgtgctctaccagggcgtgaactgcaccgaggtcccggtggccatccacgccgaccagctgacgcccacctggcgcgtgtactccaccgggagcaacgtcttccagacccgggccggctgcctgatcggggcggagtacgtgaacaactcctacgagtgcgacatccccatcggcgccggcatctgcgccagctaccagacgcagaccaacagcccccgccgggcccgcagcgtggcgtcccagagcatcatcgcctacaccatgtccctcggggccgagaacagcgtcgcctactccaacaacagcatcgccatcccgaccaacttcacgatcagcgtgaccaccgagatcctgcccgtgtccatgaccaagacgagcgtcgactgcaccatgtacatctgcggcgactccaccgagtgcagcaacctgctcctgcagtacgggtccttctgcacccagctgaaccgggcgctcacgggcatcgccgtggagcaggacaagaacacccaggaggtgttcgcccaggtcaagcagatctacaagaccccgcccatcaaggacttcgggggcttcaacttcagccagatcctgcccgacccctccaagcccagcaagcgctccttcatcgaggacctcctgttcaacaaggtgaccctggccgacgccggcttcatcaagcagtacggggactgcctgggcgacatcgcggcccgggacctcatctgcgcccagaagttcaacgggctgacggtgctgcccccgctcctgaccgacgagatgatcgcccagtacaccagcgccctgctcgcgggcaccatcacgtccgggtggaccttcggcgccggcgccgccctgcagatccccttcgcgatgcagatggcctaccgcttcaacgggatcggcgtcacccagaacgtgctgtacgagaaccagaagctcatcgccaaccagttcaacagcgccatcgggaagatccaggactccctgagctccaccgccagcgcgctgggcaagctccaggacgtggtcaaccagaacgcccaggccctgaacacgctggtgaagcagctctccagcaacttcggggccatctccagcgtgctgaacgacatcctgagccggctcgacaaggtcgaggccgaggtgcagatcgaccgcctgatcaccggccggctgcagtccctccagacctacgtgacccagcagctgatccgcgcggccgagatccgggccagcgccaacctggccgcgatcaagatgtccgagtgcgtcctcggccagagcaagcgcgtggacttctgcgggaagggctaccacctgatgtccttcccccagagcgcgccccacggggtggtcttcctgcacgtgacctacgtcccggcccaggagaagaacttcacgaccgcccccgccatctgccacgacggcaaggcccacttcccccgggagggggtgttcgtgtccaacggcacccactggttcgtcacccagcgcaacttctacgagccccagatcatcacgaccgacaacaccttcgtgagcggcaactgcgacgtggtcatcgggatcgtgaacaacaccgtgtacgacccgctccagcccgagctggactccttcaaggaggagctggacaagtacttcaagaaccacacgagccccgacgtcgacctcggcgacatctccgggatcaacgccagcgtggtgaacatccagaaggagatcgaccggctgaacgaggtcgccaagaacctgaacgagtccctcatcgacctgcaggagctgggcaagtacgagcagtacatcaagtggccctggtacatctggctcggcttcatcgccgggctgatcgcgatcgtgatggtgaccatcatgctgtgctgcatgaccagctgctgctcctgcctcaagggctgctgcagctgcgggtcctgctgcaagttcgacgaggacgacagcgagccggtcctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23444 - RNA, 4094 nt, synthetic construct
  misc_feature 1..4094: note = SARS-CoV-2/Wuhan/WIV05/2019__EPI_ISL_402128 spike protein mRNA gc (1-1273)(S13I_W152C_L452R_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagcatccagtgcgtgaacctcaccacccgcacgcagctgccgcccgcctacaccaactccttcacccggggcgtctactaccccgacaaggtgttccgcagctccgtgctgcacagcacccaggacctcttcctgcccttcttctccaacgtcacgtggttccacgccatccacgtgagcgggaccaacggcaccaagcggttcgacaacccggtgctgcccttcaacgacggggtctacttcgcgtccaccgagaagtccaacatcatccgcggctggatcttcgggacgaccctcgacagcaagacccagagcctgctgatcgtgaacaacgccaccaacgtggtcatcaaggtgtgcgagttccagttctgcaacgaccccttcctcggcgtgtactaccacaagaacaacaagtcctgcatggagagcgagttccgggtctactccagcgccaacaactgcacgttcgagtacgtgtcccagcccttcctgatggacctggagggcaagcaggggaacttcaagaacctccgcgagttcgtgttcaagaacatcgacggctacttcaagatctacagcaagcacaccccgatcaacctggtccgggacctgccccaggggttctccgccctcgagcccctggtggacctgcccatcggcatcaacatcacccgcttccagaccctcctggccctgcaccggagctacctcacgccgggggactccagcagcggctggaccgcgggcgccgccgcctactacgtggggtacctgcagccccgcaccttcctgctcaagtacaacgagaacggcaccatcacggacgcggtcgactgcgccctggaccccctgtccgagaccaagtgcaccctcaagagcttcaccgtggagaaggggatctaccagacgtccaacttccgggtgcagcccaccgagagcatcgtccgcttcccgaacatcaccaacctgtgccccttcggcgaggtgttcaacgccacccggttcgcctccgtctacgcctggaaccgcaagcggatcagcaactgcgtggcggactactccgtgctgtacaacagcgcctccttcagcacgttcaagtgctacggcgtctcccccaccaagctcaacgacctgtgcttcaccaacgtgtacgccgacagcttcgtgatccgcggggacgaggtccggcagatcgcccccggccagaccgggaagatcgccgactacaactacaagctgccggacgacttcacgggctgcgtgatcgcgtggaactccaacaacctcgacagcaaggtcgggggcaactacaactaccgctaccggctgttccgcaagtccaacctgaagcccttcgagcgggacatcagcaccgagatctaccaggccggctccaccccctgcaacggggtggagggcttcaactgctacttccccctccagagctacgggttccagccgaccaacggcgtggggtaccagccctaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgccgttccagcagttcgggcgcgacatcgccgacacgaccgacgcggtccgggacccccagaccctggagatcctggacatcaccccctgcagcttcggcggggtgagcgtgatcacgccgggcaccaacacctccaaccaggtcgccgtgctctaccagggcgtgaactgcaccgaggtccccgtggccatccacgccgaccagctgacgcccacctggcgcgtgtacagcaccgggtccaacgtcttccagacccgggccggctgcctgatcggggcggagcacgtgaacaacagctacgagtgcgacatccccatcggcgccggcatctgcgcctcctaccagacgcagaccaacagcccgcgccgggcccgctccgtggcgagccagtccatcatcgcctacaccatgagcctcggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctgctcctgcagtacgggagcttctgcacccagctgaaccgggcgctcacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcgcagcttcatcgaggacctcctgttcaacaaggtgaccctggccgacgccggcttcatcaagcagtacggggactgcctgggcgacatcgcggcccgggacctcatctgcgcccagaagttcaacgggctgaccgtgctgccgcccctcctgaccgacgagatgatcgcccagtacacctccgccctgctcgcgggcaccatcacgagcgggtggaccttcggcgccggcgccgccctgcagatccccttcgcgatgcagatggcctaccgcttcaacgggatcggcgtcacccagaacgtgctgtacgagaaccagaagctcatcgccaaccagttcaactccgccatcgggaagatccaggacagcctgtccagcaccgcctccgcgctgggcaagctccaggacgtggtcaaccagaacgcccaggccctgaacacgctggtgaagcagctcagctccaacttcggggccatcagctccgtgctgaacgacatcctgagccggctcgacaaggtcgaggccgaggtgcagatcgaccgcctgatcaccggccggctgcagtccctccagacctacgtgacccagcagctgatccgcgcggccgagatccgggccagcgccaacctggccgcgaccaagatgagcgagtgcgtcctcggccagtccaagcgcgtggacttctgcgggaagggctaccacctgatgagcttcccccagtccgccccgcacggggtggtcttcctgcacgtgacgtacgtccccgcccaggagaagaacttcaccaccgcccccgcgatctgccacgacggcaaggcccacttcccccgggagggggtgttcgtgagcaacggcacccactggttcgtcacgcagcgcaacttctacgagccgcagatcatcaccaccgacaacaccttcgtgtccggcaactgcgacgtggtcatcgggatcgtgaacaacacggtgtacgaccccctccagcccgagctggacagcttcaaggaggagctggacaagtacttcaagaaccacacctcccccgacgtcgacctcggcgacatcagcgggatcaacgcctccgtggtgaacatccagaaggagatcgaccggctgaacgaggtcgccaagaacctgaacgagagcctcatcgacctgcaggagctgggcaagtacgagcagtacatcaagtggccgtggtacatctggctcggcttcatcgccgggctgatcgcgatcgtgatggtgaccatcatgctgtgctgcatgacctcctgctgcagctgcctcaagggctgctgctcctgcgggagctgctgcaagttcgacgaggacgactccgagcccgtcctgaagggcgtgaagctgcactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23445 - RNA, 4094 nt, synthetic construct
  misc_feature 1..4094: note = SARS-CoV-2/Wuhan/WIV05/2019__EPI_ISL_402128 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccaggacgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23446 - RNA, 4094 nt, synthetic construct
  misc_feature 1..4094: note = SARS-CoV-2/Wuhan/WIV05/2019__EPI_ISL_402128 spike protein mRNA gc (1-1273)(D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23447 - RNA, 4094 nt, synthetic construct
  misc_feature 1..4094: note = SARS-CoV-2/Wuhan/WIV05/2019__EPI_ISL_402128 spike protein mRNA gc (1-1273)(A222V_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23448 - RNA, 4094 nt, synthetic construct
  misc_feature 1..4094: note = SARS-CoV-2/Wuhan/WIV05/2019__EPI_ISL_402128 spike protein mRNA gc (1-1273)(N439K_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaagaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23449 - RNA, 4094 nt, synthetic construct
  misc_feature 1..4094: note = SARS-CoV-2/Wuhan/WIV05/2019__EPI_ISL_402128 spike protein mRNA gc (1-1273)(S477N_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23450 - RNA, 4094 nt, synthetic construct
  misc_feature 1..4094: note = SARS-CoV-2/Wuhan/WIV05/2019__EPI_ISL_402128 spike protein mRNA gc (1-1273)(N501Y_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23451 - RNA, 4088 nt, synthetic construct
  misc_feature 1..4088: note = SARS-CoV-2/Wuhan/WIV05/2019__EPI_ISL_402128 spike protein mRNA gc (1-1273)(H69del_V70del_D614G)
  source 1..4088: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23452 - RNA, 4094 nt, synthetic construct
  misc_feature 1..4094: note = SARS-CoV-2/Wuhan/WIV05/2019__EPI_ISL_402128 spike protein mRNA gc (1-1273)(Y453F_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23453 - RNA, 4094 nt, synthetic construct
  misc_feature 1..4094: note = SARS-CoV-2/Wuhan/WIV05/2019__EPI_ISL_402128 spike protein mRNA gc (1-1273)(D614G_I692V)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23454 - RNA, 4094 nt, synthetic construct
  misc_feature 1..4094: note = SARS-CoV-2/Wuhan/WIV05/2019__EPI_ISL_402128 spike protein mRNA gc (1-1273)(D614G_M1229I)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23455 - RNA, 4088 nt, synthetic construct
  misc_feature 1..4088: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4088: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23456 - RNA, 4088 nt, synthetic construct
  misc_feature 1..4088: note = SARS-CoV-2/Wuhan/WIV05/2019__EPI_ISL_402128 spike protein mRNA gc (1-1273)(H69del_V70del_Y453F_D614G_I692V_M1229I)
  source 1..4088: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23457 - RNA, 4085 nt, synthetic construct
  misc_feature 1..4085: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4085: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgacgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcacaccggagggcaaggagcgtggccagccagagcatcatcgcctacaccatgagcctgggcgccgagaacagcgtggcctacagcaacaacagcatcgccatccccatcaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctggcccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23458 - RNA, 4094 nt, synthetic construct
  misc_feature 1..4094: note = SARS-CoV-2/Wuhan/WIV05/2019__EPI_ISL_402128 spike protein mRNA gc (1-1273)(K417N_E484K_N501Y_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23459 - RNA, 4085 nt, synthetic construct
  misc_feature 1..4085: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4085: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacttcaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgccaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcggggcctgccccagggcttctcagccctggagcccctggtggacctgcccatcggcatcaacatcacccggttccagaccctgcacatcagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgtggagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23460 - RNA, 4094 nt, synthetic construct
  misc_feature 1..4094: note = SARS-CoV-2/Wuhan/WIV05/2019__EPI_ISL_402128 spike protein mRNA gc (1-1273)(E484K_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23461 - RNA, 4094 nt, synthetic construct
  misc_feature 1..4094: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacttcaccaaccggacccagctgccaagcgcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaactaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgagcgagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaccatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagtacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccatcaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23462 - RNA, 4094 nt, synthetic construct
  misc_feature 1..4094: note = SARS-CoV-2/Wuhan/WIV05/2019__EPI_ISL_402128 spike protein mRNA gc (1-1273)(S13I_W152C_L452R_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcatccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctgcatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactaccgctaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23463 - RNA, 4094 nt, synthetic construct
  misc_feature 1..4094: note = SARS-CoV-2/Wuhan/WIV05/2019__EPI_ISL_402128 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccaggacgtgaactgcaccgaggtgcccgtggccatccacgccgaccagctgacccccacctggcgggtgtacagcaccggaagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgattgcctgggcgacatcgccgctcgggacctgatctgcgcccagaagttcaacgggctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggcgtgttcgtgagcaacggaacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgatgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23464 - RNA, 4094 nt, synthetic construct
  misc_feature 1..4094: note = SARS-CoV-2/Wuhan/WIV05/2019__EPI_ISL_402128 spike protein mRNA gc (1-1273)(D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23465 - RNA, 4094 nt, synthetic construct
  misc_feature 1..4094: note = SARS-CoV-2/Wuhan/WIV05/2019__EPI_ISL_402128 spike protein mRNA gc (1-1273)(A222V_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtcagcgtgatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagcccccggcgggcccggagcgtggccagccagagcatcatcgcctacaccatgagcttaggcgccgagaacagcgtggcctacagcaacaacagcatcgccatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttttgcggcaagggctaccacctgatgagcttcccccagagcgccccacacggcgtggtcttcctccacgtgacatacgtgcccgcccaggagaagaacttcaccaccgcccccgccatttgccacgacggcaaggcccacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgctagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23466 - RNA, 4094 nt, synthetic construct
  misc_feature 1..4094: note = SARS-CoV-2/Wuhan/WIV05/2019__EPI_ISL_402128 spike protein mRNA gc (1-1273)(N439K_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaagaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggacaaggtggaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23467 - RNA, 4094 nt, synthetic construct
  misc_feature 1..4094: note = SARS-CoV-2/Wuhan/WIV05/2019__EPI_ISL_402128 spike protein mRNA gc (1-1273)(S477N_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcaacaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgcgcctcctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaatttcggcgccatcagcagcgtgctgaacgacatcctgtcaaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23468 - RNA, 4094 nt, synthetic construct
  misc_feature 1..4094: note = SARS-CoV-2/Wuhan/WIV05/2019__EPI_ISL_402128 spike protein mRNA gc (1-1273)(N501Y_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggacaaggtggaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23469 - RNA, 4088 nt, synthetic construct
  misc_feature 1..4088: note = SARS-CoV-2/Wuhan/WIV05/2019__EPI_ISL_402128 spike protein mRNA gc (1-1273)(H69del_V70del_D614G)
  source 1..4088: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtgacatacgtccccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23470 - RNA, 4094 nt, synthetic construct
  misc_feature 1..4094: note = SARS-CoV-2/Wuhan/WIV05/2019__EPI_ISL_402128 spike protein mRNA gc (1-1273)(Y453F_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23471 - RNA, 4094 nt, synthetic construct
  misc_feature 1..4094: note = SARS-CoV-2/Wuhan/WIV05/2019__EPI_ISL_402128 spike protein mRNA gc (1-1273)(D614G_I692V)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtcttcctccacgtgacatacgtgcccgcccaggagaagaacttcaccaccgcccccgccatctgccacgacggcaaggctcacttcccccgggagggagtgttcgtgagcaacggcacccactggttcgtgacccagcggaacttctacgagccccagattatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23472 - RNA, 4094 nt, synthetic construct
  misc_feature 1..4094: note = SARS-CoV-2/Wuhan/WIV05/2019__EPI_ISL_402128 spike protein mRNA gc (1-1273)(D614G_M1229I)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23473 - RNA, 4088 nt, synthetic construct
  misc_feature 1..4088: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4088: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcaacaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtgagcgtcatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgccggcatctgcgcttcctaccagacccagaccaacagcccccggcgggcccggagcgtggccagccagagcgtgatcgcctacaccatgagcttaggcgccgagaacagcgtggcctacagcaacaacagcatcgccatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaattttggcgccatcagcagcgtgctgaacgacatcctgtcaaggctggacaaggtggaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttctgcggcaagggctaccacctgatgagcttcccccagagcgccccacacggcgtggtcttcctccacgtgacatacgtgcccgcccaggagaagaacttcaccaccgcccccgccatctgccacgacggcaaggcccacttcccccgggagggagtgttcgtgagcaacggcacccactggttcgtgacccagcggaacttctacgagccccagattatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgctagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23474 - RNA, 4088 nt, synthetic construct
  misc_feature 1..4088: note = SARS-CoV-2/Wuhan/WIV05/2019__EPI_ISL_402128 spike protein mRNA gc (1-1273)(H69del_V70del_Y453F_D614G_I692V_M1229I)
  source 1..4088: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgccccacacggcgtggtgttcctccacgtcacatacgtgcccgcccaggagaagaacttcaccaccgcccccgccatctgccacgacggcaaggctcacttcccccgggagggagtgttcgtgagcaacggcacccactggttcgtgacccagcggaacttctacgagccccagattatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23475 - RNA, 4085 nt, synthetic construct
  misc_feature 1..4085: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4085: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgacgacaccaccgacgccgtgcgggacccccagaccctggagatcctggacatcaccccatgcagcttcggcggcgtgagcgtgatcacccccggcacaaacaccagcaaccaggtcgcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagccaccggcgggcccggagcgtggccagccagagcatcatcgcctacaccatgagcttaggcgccgagaacagcgtggcctacagcaacaacagcatcgccatccccatcaacttcaccataagcgtgaccaccgagatcctgcctgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagaccccacccatcaaggacttcggcggcttcaacttcagccagatcctgcccgaccccagcaagcccagcaagcggagcttcatcgaggacctgctgttcaacaaggtgactctggccgacgccggcttcatcaagcagtacggcgattgcctgggggacatcgccgcccgggacctgatctgcgctcagaagttcaacggcctgaccgtgctgcctcccctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaacgacatcctggccaggctggacaaggtggaggccgaggtgcagatcgaccggctgatcaccggccggctgcagagcctgcagacctacgtgacccagcagctgatccgggccgccgagattcgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacctacgtcccagcccaggagaagaacttcacaaccgcccccgccatctgccacgacggcaaggcccacttcccccgggagggagtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgaccccctgcagcccgagctggacagcttcaaggaggagctggacaagtacttcaagaaccacaccagccctgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23476 - RNA, 4094 nt, synthetic construct
  misc_feature 1..4094: note = SARS-CoV-2/Wuhan/WIV05/2019__EPI_ISL_402128 spike protein mRNA gc (1-1273)(K417N_E484K_N501Y_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23477 - RNA, 4085 nt, synthetic construct
  misc_feature 1..4085: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4085: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacttcaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgccaacccagtgctgcccttcaacgacggcgtgtacttcgccagcaccgagaagtcaaacatcatccggggctggatctttggcaccaccctggacagcaagacacagagcctgctgatcgtgaacaacgctaccaacgtggtgatcaaggtgtgcgagttccagttctgcaacgaccccttcctgggcgtgtactaccacaagaacaacaagagctggatggagagcgagttccgggtctacagcagcgccaacaattgcaccttcgagtacgtgagccagcccttcctgatggacctggagggcaagcagggcaacttcaagaacctccgggagttcgtgttcaagaacatcgacggctacttcaagatctacagcaagcacacccccatcaacctggtgcggggactgccccagggcttcagcgccctggagcctctggtggatctgcccatcggcatcaacatcaccaggttccagaccctgcacatcagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcacccttaagagcttcaccgtggagaagggcatctaccagaccagcaacttccgggtgcagcccactgagagcattgtgcggttccccaacatcaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctattccgtaagagcaacctgaagccatttgagcgggacatcagcaccgagatctaccaggccggtagcaccccctgcaacggcgtgaagggcttcaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggacatcgccgacaccaccgatgcagtgcgggacccccagaccctggagatcctggacatcaccccatgcagcttcggcggcgtgagcgtcatcacccccggaacaaacaccagcaaccaggtggccgtgctgtaccagggcgtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcctgggcgtggagaacagcgtggcctacagcaacaacagcatcgccatccctaccaacttcaccataagcgtgaccaccgagatcctgcccgtgagcatgaccaagaccagcgtggactgtaccatgtacatctgcggcgacagcaccgagtgcagcaacctgttactgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggggactgcctgggcgacatcgccgcccgggacctgatctgcgctcagaagttcaacggcctgaccgtgctgccccctctgctgaccgatgagatgatcgcccagtacaccagcgccctgctggccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaactttggcgccatcagctcagtgctgaatgacatcctgagccggctggacaaggtggaggccgaggtgcagatcgacaggctgatcaccggccggctgcagagcctgcagacctacgtgacccagcagctgatccgggccgccgagattcgggccagcgccaacctggccgcaaccaagatgagcgagtgcgtgctgggccagagcaagcgggtggacttctgcggcaagggctaccacctgatgagcttcccccagagcgccccacacggcgtggtcttcctgcacgtgacatacgtgcccgcccaggagaagaacttcaccaccgcccccgccatctgccacgacggaaaggcccacttcccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctcgacaagtacttcaagaaccacaccagccccgacgtggacctgggcgacatcagcggcatcaacgctagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23478 - RNA, 4094 nt, synthetic construct
  misc_feature 1..4094: note = SARS-CoV-2/Wuhan/WIV05/2019__EPI_ISL_402128 spike protein mRNA gc (1-1273)(E484K_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23479 - RNA, 4094 nt, synthetic construct
  misc_feature 1..4094: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacttcaccaaccggacccagctgcccagcgcctacaccaacagcttcacccggggcgtgtactaccctgacaaggtgttccggagcagcgtgctgcacagcacccaggacctgttcctgcccttcttcagcaacgtgacctggttccacgccatccacgtgagcggcaccaacggcaccaagcggttcgacaaccccgtgctgccattcaacgacggcgtgtacttcgccagcaccgagaagtcaaacatcatccggggctggatctttggcaccaccctggacagcaagacccagagcctgctgatcgtgaacaacgccacaaacgtggtgatcaaggtgtgcgagttccagttctgcaactaccccttcctgggcgtgtactaccacaagaacaacaagagctggatggagagcgagttccgggtctacagcagcgctaataactgcaccttcgagtacgtgagccagcccttcctgatggacctggagggcaagcagggcaacttcaagaacctcagcgagttcgtgttcaagaacatcgacggctacttcaagatctacagcaagcacacccccatcaacctggtgcgggatctgccccagggattcagcgccctggagcccctggtggacctgcctatcggcatcaacatcacccggttccagaccctgctggccctgcacaggagctacctgacccccggcgacagcagcagcggctggaccgccggcgccgccgcatactacgtgggctacctgcagccccggaccttcctgctgaagtacaacgagaacggcaccatcaccgacgccgtggactgcgccctggacccactgagcgagaccaagtgcaccctaaagagcttcaccgtggagaagggcatctaccagaccagcaacttccgggtgcagcccaccgagagcatcgtgcggttccccaacattactaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgctgacagcttcgtgatccggggcgacgaggtgcggcagatcgcccctggccagaccggcaccatcgccgactacaactacaagctgcccgacgacttcaccggctgcgtgatcgcctggaacagcaacaacctggacagcaaggtgggcggcaactacaactacctgtaccggctgttccgtaagagcaacctgaagccctttgagcgggacatcagcaccgagatctaccaggccggcagcaccccatgcaacggtgtgaagggcttcaactgctacttccccctgcagagctacggcttccagcccacctacggcgtgggctaccagccctaccgggtggtggtgctgagcttcgagctgctgcacgcccccgccaccgtgtgcggccccaaaaagagcaccaacctggtgaagaacaagtgcgtgaacttcaatttcaacggcctgaccggcaccggcgtgctgaccgagagcaacaagaagttcctgcctttccagcagttcggccgggacatcgccgataccaccgacgcagtgcgggacccccagaccctggagatcctggacatcaccccctgcagcttcggcggcgtgagcgtcatcaccccaggcacaaacaccagcaaccaggtggccgtgctgtaccagggagtgaactgcaccgaggtgcccgtggccatccacgccgaccagctgacccccacctggcgggtgtactccaccggcagcaacgtgttccagacccgggccggctgcctgatcggcgccgagtacgtgaacaacagctacgagtgcgacatccccatcggcgctggcatctgcgccagctaccagacccagaccaacagcccccggcgggcccggagcgtggccagccagagcatcatcgcctacaccatgagcctgggcgccgagaacagcgtggcctacagcaacaacagcatcgcgatccccaccaacttcaccatcagcgtgaccaccgagatattacctgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactccacccatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggacatcgccgctcgggatctgatctgcgcccagaagttcaacggcctgaccgtgctgcctcccctgctgaccgacgagatgatcgcccagtacaccagcgccctgctggccggcaccatcaccagcggctggaccttcggcgccggcgcagcccttcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagctcaaactttggcgccatcagcagcgtgctgaatgacatcctgagccggctggacaaggtggaggccgaggtgcagatcgacaggctgatcaccggccggctgcagagcctgcagacctacgtgacccagcagctgatccgggccgccgagatccgggccagcgccaacctggcagccattaagatgagcgagtgcgtgctgggccagagcaagcgggtggacttctgcggcaagggctaccacctgatgagcttcccccagagcgctccccacggcgtggtgttcctgcacgtcacctacgtgccagcccaggagaagaacttcacaaccgcccccgccatctgccacgacggcaaggcccacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctccagcccgagctggacagcttcaaggaggagctggacaagtacttcaagaaccacaccagccctgacgtggacctgggcgatatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23480 - RNA, 4094 nt, synthetic construct
  misc_feature 1..4094: note = SARS-CoV-2/Wuhan/WIV05/2019__EPI_ISL_402128 spike protein mRNA gc (1-1273)(S13I_W152C_L452R_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcatccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctgcatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgtaccctaaagagcttcaccgtggagaagggcatctaccagaccagcaacttccgggtgcagcccactgagagcattgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactaccggtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgtgcctcctaccagacccagaccaacagcccccggcgggcccggagcgtggccagccagagcatcatcgcctacaccatgagcctgggcgccgagaacagcgtggcctacagcaacaacagcatcgcgatccctaccaacttcaccataagcgtgaccaccgagatcttacccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgctggccggcaccatcaccagcggctggaccttcggcgccggcgcagcccttcagatccccttcgccatgcagatggcctacaggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagcagcgtgctgaatgacatcctgtcacggctggacaaggtggaggccgaggtgcagatcgaccggctgatcaccggccggctgcagagcctgcagacctacgtgacccagcagctgatccgggccgccgagattcgggccagcgccaacctggcagccaccaagatgagcgagtgcgtgctgggccagagcaagcgggtggacttttgcggcaagggctaccacctgatgagcttcccccagagcgccccacacggcgtggtgttcctgcacgtcacatacgtgcccgcccaggagaagaacttcaccaccgcccccgccatctgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctccagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgttgcagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23481 - RNA, 4094 nt, synthetic construct; identical to SEQ ID NO: 12540
  misc_feature 1..4094: note = SARS-CoV-2/Wuhan/WIV05/2019__EPI_ISL_402128 spike protein mRNA gc mod (1-1273)
  source 1..4094: mol_type = other RNA

SEQ ID NO: 23482 - RNA, 4094 nt, synthetic construct
  misc_feature 1..4094: note = SARS-CoV-2/Wuhan/WIV05/2019__EPI_ISL_402128 spike protein mRNA gc mod (1-1273)(D614G)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23483 - RNA, 4094 nt, synthetic construct
  misc_feature 1..4094: note = SARS-CoV-2/Wuhan/WIV05/2019__EPI_ISL_402128 spike protein mRNA gc mod (1-1273)(A222V_D614G)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23484 - RNA, 4094 nt, synthetic construct
  misc_feature 1..4094: note = SARS-CoV-2/Wuhan/WIV05/2019__EPI_ISL_402128 spike protein mRNA gc mod (1-1273)(N439K_D614G)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23485 - RNA, 4094 nt, synthetic construct
  misc_feature 1..4094: note = SARS-CoV-2/Wuhan/WIV05/2019__EPI_ISL_402128 spike protein mRNA gc mod (1-1273)(S477N_D614G)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23486 - RNA, 4094 nt, synthetic construct
  misc_feature 1..4094: note = SARS-CoV-2/Wuhan/WIV05/2019__EPI_ISL_402128 spike protein mRNA gc mod (1-1273)(N501Y_D614G)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23487 - RNA, 4088 nt, synthetic construct
  misc_feature 1..4088: note = SARS-CoV-2/Wuhan/WIV05/2019__EPI_ISL_402128 spike protein mRNA gc mod (1-1273)(H69del_V70del_D614G)
  source 1..4088: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23488 - RNA, 4094 nt, synthetic construct
  misc_feature 1..4094: note = SARS-CoV-2/Wuhan/WIV05/2019__EPI_ISL_402128 spike protein mRNA gc mod (1-1273)(Y453F_D614G)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23489 - RNA, 4094 nt, synthetic construct
  misc_feature 1..4094: note = SARS-CoV-2/Wuhan/WIV05/2019__EPI_ISL_402128 spike protein mRNA gc mod (1-1273)(D614G_I692V)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23490 - RNA, 4094 nt, synthetic construct
  misc_feature 1..4094: note = SARS-CoV-2/Wuhan/WIV05/2019__EPI_ISL_402128 spike protein mRNA gc mod (1-1273)(D614G_M1229I)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23491 - RNA, 4088 nt, synthetic construct
  misc_feature 1..4088: note = SARS-CoV-2/Wuhan/WIV05/2019__EPI_ISL_402128 spike protein mRNA gc mod (1-1273)(H69del_V70del_A222V_Y453F_S477N_D614G_I692V)
  source 1..4088: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23492 - RNA, 4088 nt, synthetic construct
  misc_feature 1..4088: note = SARS-CoV-2/Wuhan/WIV05/2019__EPI_ISL_402128 spike protein mRNA gc mod (1-1273)(H69del_V70del_Y453F_D614G_I692V_M1229I)
  source 1..4088: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23493 - RNA, 4085 nt, synthetic construct
  misc_feature 1..4085: note = SARS-CoV-2/Wuhan/WIV05/2019__EPI_ISL_402128 spike protein mRNA gc mod (1-1273)(H69del_V70del_Y144del_N501Y_A570D_D614G_P681H_T716 I_S982A_D1118H)
  source 1..4085: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccacagacgggctagaagcgtggccagccagagcatcattgcctacacaatgtctctgggcgccgagaacagcgtggcctactccaacaactctatcgctatccccatcaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23494 - RNA, 4094 nt, synthetic construct
  misc_feature 1..4094: note = SARS-CoV-2/Wuhan/WIV05/2019__EPI_ISL_402128 spike protein mRNA gc mod (1-1273)(K417N_E484K_N501Y_D614G)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23495 - RNA, 4085 nt, synthetic construct
  misc_feature 1..4085: note = SARS-CoV-2/Wuhan/WIV05/2019__EPI_ISL_402128 spike protein mRNA gc mod (1-1273)(L18F_D80A_D215G_L242del_A243del_L244del_R246I_K417 N_E484K_N501Y_D614G_A701V)
  source 1..4085: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacttcaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgtggagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23496 - RNA, 4094 nt, synthetic construct
  misc_feature 1..4094: note = SARS-CoV-2/Wuhan/WIV05/2019__EPI_ISL_402128 spike protein mRNA gc mod (1-1273)(E484K_D614G)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23497 - RNA, 4094 nt, synthetic construct
  misc_feature 1..4094: note = SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G _H655Y_T1027I)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacttcaccaacagaacacagctgcctagcgcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23498 - RNA, 4094 nt, synthetic construct
  misc_feature 1..4094: note = SARS-CoV-2/Wuhan/WIV05/2019__EPI_ISL_402128 spike protein mRNA gc mod (1-1273)(S13I_W152C_L452R_D614G)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccatccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23499 - RNA, 4094 nt, synthetic construct
  misc_feature 1..4094: note = SARS-CoV-2/Wuhan/WIV05/2019__EPI_ISL_402128 spike protein mRNA gc mod (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23500 - RNA, 4094 nt, synthetic construct
  misc_feature 1..4094: note = SARS-CoV-2/Wuhan/WIV05/2019__EPI_ISL_402128 spike protein mRNA gc mod (1-1273)(D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23501 - RNA, 4094 nt, synthetic construct
  misc_feature 1..4094: note = SARS-CoV-2/Wuhan/WIV05/2019__EPI_ISL_402128 spike protein mRNA gc mod (1-1273)(A222V_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23502 - RNA, 4094 nt, synthetic construct
  misc_feature 1..4094: note = SARS-CoV-2/Wuhan/WIV05/2019__EPI_ISL_402128 spike protein mRNA gc mod (1-1273)(N439K_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23503 - RNA, 4094 nt, synthetic construct
  misc_feature 1..4094: note = SARS-CoV-2/Wuhan/WIV05/2019__EPI_ISL_402128 spike protein mRNA gc mod (1-1273)(S477N_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23504 - RNA, 4094 nt, synthetic construct
  misc_feature 1..4094: note = SARS-CoV-2/Wuhan/WIV05/2019__EPI_ISL_402128 spike protein mRNA gc mod (1-1273)(N501Y_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23505 - RNA, 4088 nt, synthetic construct
  misc_feature 1..4088: note = SARS-CoV-2/Wuhan/WIV05/2019__EPI_ISL_402128 spike protein mRNA gc mod (1-1273)(H69del_V70del_D614G)
  source 1..4088: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23506 - RNA, 4094 nt, synthetic construct
  misc_feature 1..4094: note = SARS-CoV-2/Wuhan/WIV05/2019__EPI_ISL_402128 spike protein mRNA gc mod (1-1273)(Y453F_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23507 - RNA, 4094 nt, synthetic construct
  misc_feature 1..4094: note = SARS-CoV-2/Wuhan/WIV05/2019__EPI_ISL_402128 spike protein mRNA gc mod (1-1273)(D614G_I692V)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23508 - RNA, 4094 nt, synthetic construct
  misc_feature 1..4094: note = SARS-CoV-2/Wuhan/WIV05/2019__EPI_ISL_402128 spike protein mRNA gc mod (1-1273)(D614G_M1229I)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23509 - RNA, 4088 nt, synthetic construct
  misc_feature 1..4088: note = SARS-CoV-2/Wuhan/WIV05/2019__EPI_ISL_402128 spike protein mRNA gc mod (1-1273)(H69del_V70del_A222V_Y453F_S477N_D614G_I692V)
  source 1..4088: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23510 - RNA, 4088 nt, synthetic construct
  misc_feature 1..4088: note = SARS-CoV-2/Wuhan/WIV05/2019__EPI_ISL_402128 spike protein mRNA gc mod (1-1273)(H69del_V70del_Y453F_D614G_I692V_M1229I)
  source 1..4088: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23511 - RNA, 4085 nt, synthetic construct
  misc_feature 1..4085: note = SARS-CoV-2/Wuhan/WIV05/2019__EPI_ISL_402128 spike protein mRNA gc mod (1-1273)(H69del_V70del_Y144del_N501Y_A570D_D614G_P681H_T716 I_S982A_D1118H)
  source 1..4085: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccaccggagagccagaagcgtggccagccagagcatcattgcctacacaatgtctctgggcgccgagaacagcgtggcctactccaacaactctatcgctatccccatcaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23512 - RNA, 4094 nt, synthetic construct
  misc_feature 1..4094: note = SARS-CoV-2/Wuhan/WIV05/2019__EPI_ISL_402128 spike protein mRNA gc mod (1-1273)(K417N_E484K_N501Y_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23513 - RNA, 4085 nt, synthetic construct
  misc_feature 1..4085: note = SARS-CoV-2/Wuhan/WIV05/2019__EPI_ISL_402128 spike protein mRNA gc mod (1-1273)(L18F_D80A_D215G_L242del_A243del_L244del_R246I_K417 N_E484K_N501Y_D614G_A701V)
  source 1..4085: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacttcaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgtggagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23514 - RNA, 4094 nt, synthetic construct
  misc_feature 1..4094: note = SARS-CoV-2/Wuhan/WIV05/2019__EPI_ISL_402128 spike protein mRNA gc mod (1-1273)(E484K_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23515 - RNA, 4094 nt, synthetic construct
  misc_feature 1..4094: note = SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G _H655Y_T1027I)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacttcaccaacagaacacagctgcctagcgcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23516 - RNA, 4094 nt, synthetic construct
  misc_feature 1..4094: note = SARS-CoV-2/Wuhan/WIV05/2019__EPI_ISL_402128 spike protein mRNA gc mod (1-1273)(S13I_W152C_L452R_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccatccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23517 - RNA, 4094 nt, synthetic construct; identical to SEQ ID NO: 149
  misc_feature 1..4094: note = SARS-CoV-2/Wuhan/WIV05/2019__EPI_ISL_402128 spike protein mRNA gc (1-1273)(K986P_V987P) R9487, R9491, R9709, R10159, R10160
  source 1..4094: mol_type = other RNA

SEQ ID NO: 23518 - RNA, 4094 nt, synthetic construct; identical to SEQ ID NO: 22792
  misc_feature 1..4094: note = SARS-CoV-2/Wuhan/WIV05/2019__EPI_ISL_402128 spike protein mRNA gc (1-1273)(K986P_V987P_ D614G) R10166
  source 1..4094: mol_type = other RNA

SEQ ID NO: 23519 - RNA, 4094 nt, synthetic construct; identical to SEQ ID NO: 22794
  misc_feature 1..4094: note = SARS-CoV-2/Wuhan/WIV05/2019__EPI_ISL_402128 spike protein mRNA gc (1-1273)(K986P_V987P_A222V_D614G) R10279
  source 1..4094: mol_type = other RNA

SEQ ID NO: 23520 - RNA, 4094 nt, synthetic construct; identical to SEQ ID NO: 22796
  misc_feature 1..4094: note = SARS-CoV-2/Wuhan/WIV05/2019__EPI_ISL_402128 spike protein mRNA gc (1-1273)(K986P_V987P_N439K_D614G) R10299
  source 1..4094: mol_type = other RNA

SEQ ID NO: 23521 - RNA, 4094 nt, synthetic construct; identical to SEQ ID NO: 22798
  misc_feature 1..4094: note = SARS-CoV-2/Wuhan/WIV05/2019__EPI_ISL_402128 spike protein mRNA gc (1-1273)(K986P_V987P_S477N_D614G) R10286
  source 1..4094: mol_type = other RNA

SEQ ID NO: 23522 - RNA, 4094 nt, synthetic construct; identical to SEQ ID NO: 22800
  misc_feature 1..4094: note = SARS-CoV-2/Wuhan/WIV05/2019__EPI_ISL_402128 spike protein mRNA gc (1-1273)(K986P_V987P_N501Y_D614G)
  source 1..4094: mol_type = other RNA

SEQ ID NO: 23523 - RNA, 4088 nt, synthetic construct; identical to SEQ ID NO: 22802
  misc_feature 1..4088: note = SARS-CoV-2/Wuhan/WIV05/2019__EPI_ISL_402128 spike protein mRNA gc (1-1273)(K986P_V987P_H69del_V70del_D614G) R10275
  source 1..4088: mol_type = other RNA

SEQ ID NO: 23524 - RNA, 4094 nt, synthetic construct; identical to SEQ ID NO: 22804
  misc_feature 1..4094: note = SARS-CoV-2/Wuhan/WIV05/2019__EPI_ISL_402128 spike protein mRNA gc (1-1273)(K986P_V987P_Y453F_D614G) R10283
  source 1..4094: mol_type = other RNA

SEQ ID NO: 23525 - RNA, 4094 nt, synthetic construct; identical to SEQ ID NO: 22806
  misc_feature 1..4094: note = SARS-CoV-2/Wuhan/WIV05/2019__EPI_ISL_402128 spike protein mRNA gc (1-1273)(K986P_V987P_D614G_I692V) R10291
  source 1..4094: mol_type = other RNA

SEQ ID NO: 23526 - RNA, 4094 nt, synthetic construct; identical to SEQ ID NO: 22808
  misc_feature 1..4094: note = SARS-CoV-2/Wuhan/WIV05/2019__EPI_ISL_402128 spike protein mRNA gc (1-1273)(K986P_V987P_D614G_M1229I)
  source 1..4094: mol_type = other RNA

SEQ ID NO: 23527 - RNA, 4088 nt, synthetic construct; identical to SEQ ID NO: 22810
  misc_feature 1..4088: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)R10295
  source 1..4088: mol_type = other RNA

SEQ ID NO: 23528 - RNA, 4088 nt, synthetic construct; identical to SEQ ID NO: 22812
  misc_feature 1..4088: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4088: mol_type = other RNA

SEQ ID NO: 23529 - RNA, 4085 nt, synthetic construct
  misc_feature 1..4085: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H) R10357
  source 1..4085: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgacgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactcccaccggcgcgcccggagcgtggcgtcccagagcatcatcgcctacaccatgtccctgggcgccgagaacagcgtcgcctactccaacaacagcatcgccatccccatcaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctcgcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccacccacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23530 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_K986P_V987P_K417N_E484K_N501Y_D614G) R10361
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23531 - RNA, 4085 nt, synthetic construct
  misc_feature 1..4085: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V) R10384
  source 1..4085: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacttcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgccaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccggggcctgccccaggggttcagcgccctcgagcccctggtggacctgcccatcggcatcaacatcacccgcttccagaccctccacatctcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgtggagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23532 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_K986P_V987P_E484K_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23533 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I) R10385
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacttcaccaaccgcacgcagctgccgagcgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaactaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctcagcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaccatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgatcaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23534 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagcatccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctgcatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactaccgctaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23535 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtccagatcgaccggctgatcaccgggcgcctccagagcctgcagacctacgtgacccagcagctgatccgggcggccgagatccgcgccagcgccaacctcgccgcgaccaagatgtccgagtgcgtgctgggccagagcaagcgggtcgacttctgcggcaaggggtaccacctgatgtccttcccccagagcgcgccccacggcgtggtgttcctccacgtcacgtacgtgcccgcccaggagaagaacttcaccaccgccccggccatctgccacgacgggaaggcccacttcccccgcgagggcgtcttcgtgtccaacgggacccactggttcgtgacgcagcggaacttctacgagccccagatcatcaccaccgacaacaccttcgtcagcggcaactgcgacgtggtgatcggcatcgtcaacaacacggtgtacgaccccctgcagccggagctggactccttcaaggaggagctcgacaagtacttcaagaaccacaccagccccgacgtggacctgggggacatctccggcatcaacgccagcgtcgtgaacatccagaaggagatcgaccgcctgaacgaggtggccaagaacctcaacgagtccctgatcgacctgcaggagctcgggaagtacgagcagtacatcaagtggccctggtacatctggctgggcttcatcgccggcctgatcgcgatcgtcatggtgaccatcatgctctgctgcatgaccagctgctgctcctgcctgaaggggtgctgcagctgcggctcctgctgcaagttcgacgaggacgacagcgagccggtgctgaagggggtcaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23536 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_ D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23537 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_A222V_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtgctcgagcccctggtggacctgcccatcggcatcaacatcacccgcttccagaccctcctggccctgcaccggtcctacctcacgccgggggacagcagctccggctggaccgccggcgcggccgcctactacgtcgggtacctgcagccccgcaccttcctgctcaagtacaacgagaacggcaccatcacggacgccgtggactgcgcgctggaccccctgagcgagaccaagtgcaccctcaagtccttcaccgtggagaaggggatctaccagacgagcaacttccgggtccagcccaccgagtccatcgtgcgcttcccgaacatcaccaacctgtgccccttcggcgaggtcttcaacgccacccggttcgccagcgtgtacgcctggaaccgcaagcggatctccaactgcgtggccgactacagcgtcctgtacaactccgcgagcttctccacgttcaagtgctacggcgtgagccccaccaagctcaacgacctgtgcttcaccaacgtgtacgccgactccttcgtcatccgcggggacgaggtgcggcagatcgcccccggccagaccgggaagatcgccgactacaactacaagctgccggacgacttcacgggctgcgtgatcgcctggaacagcaacaacctcgactccaaggtcgggggcaactacaactacctgtaccgcctgttccgcaagagcaacctcaagcccttcgagcgggacatctccaccgagatctaccaggcgggcagcaccccctgcaacggggtggagggcttcaactgctacttccccctgcagtcctacgggttccagccgaccaacggcgtggggtaccagccctaccgggtcgtggtgctgagcttcgagctcctgcacgcccccgccacggtctgcggccccaagaagtccaccaacctggtgaagaacaagtgcgtgaacttcaacttcaacggcctcaccgggaccggcgtcctgaccgagagcaacaagaagttcctgccgttccagcagttcgggcgcgacatcgccgacacgaccgacgccgtgcgcgacccccagaccctggagatcctcgacatcaccccctgcagcttcggcggggtgtccgtcatcacgccgggcaccaacaccagcaaccaggtggcggtgctgtaccagggcgtcaactgcaccgaggtgcccgtggccatccacgccgaccagctgacgcccacctggcgggtctactccaccgggagcaacgtgttccagacccgcgccggctgcctcatcggggccgagcacgtgaacaactcctacgagtgcgacatccccatcggcgcgggcatctgcgccagctaccagacgcagaccaactccccgcggcgcgcccggagcgtcgcctcccagagcatcatcgcgtacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgccctgacgggcatcgcggtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacccgcccgaggccgaggtgcagatcgaccggctgatcaccggccgcctccagagcctgcagacctacgtgacccagcagctgatccgggccgcggagatccgcgccagcgccaacctcgccgccaccaagatgtccgagtgcgtcctgggccagagcaagcgggtggacttctgcgggaagggctaccacctgatgtccttcccccagagcgcgccccacggggtggtcttcctccacgtgacgtacgtccccgcccaggagaagaacttcaccaccgccccggccatctgccacgacggcaaggcgcacttcccccgcgagggggtgttcgtgtccaacggcacccactggttcgtcacgcagcggaacttctacgagccccagatcatcaccaccgacaacaccttcgtgagcggcaactgcgacgtggtcatcgggatcgtgaacaacacggtgtacgaccccctgcagccggagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccctggtacatctggctgggcttcatcgccgggctgatcgccatcgtgatggtgaccatcatgctctgctgcatgaccagctgctgctcctgcctgaagggctgctgcagctgcgggtcctgctgcaagttcgacgaggacgacagcgagccggtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23538 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_N439K_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23539 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_S477N_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgagcgtgatcacgccgggcaccaacacctccaaccaggtcgccgtgctgtaccagggcgtgaactgcaccgaggtccccgtggccatccacgccgaccagctgacgcccacctggcgggtgtacagcaccgggtccaacgtcttccagacccgcgccggctgcctcatcggggcggagcacgtgaacaacagctacgagtgcgacatccccatcggcgccggcatctgcgcctcctaccagacgcagaccaacagcccgcggcgcgcccggtccgtggcgagccagtccatcatcgcctacaccatgagcctgggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctcctgctgcagtacgggagcttctgcacccagctcaaccgcgcgctgacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacacctccgccctcctggcgggcaccatcacgagcgggtggaccttcggcgccggcgccgccctgcagatccccttcgcgatgcagatggcctaccggttcaacgggatcggcgtcacccagaacgtgctctacgagaaccagaagctgatcgccaaccagttcaactccgccatcgggaagatccaggacagcctgtccagcaccgcctccgcgctcggcaagctgcaggacgtggtcaaccagaacgcccaggccctgaacacgctcgtgaagcagctgagctccaacttcggggccatcagctccgtgctgaacgacatcctcagccgcctggacccgcccgaggccgaggtccagatcgaccggctgatcaccggccgcctccagtccctgcagacctacgtgacccagcagctgatccgggcggccgagatccgcgccagcgccaacctcgccgcgaccaagatgagcgagtgcgtgctgggccagtccaagcgggtcgacttctgcgggaagggctaccacctgatgagcttcccccagtccgcgccccacggggtggtgttcctccacgtcacgtacgtgcccgcccaggagaagaacttcaccaccgccccggccatctgccacgacggcaaggcccacttcccccgcgagggggtcttcgtgagcaacggcacccactggttcgtgacgcagcggaacttctacgagccccagatcatcaccaccgacaacaccttcgtctccggcaactgcgacgtggtgatcgggatcgtcaacaacacggtgtacgaccccctgcagccggagctggacagcttcaaggaggagctcgacaagtacttcaagaaccacacctcccccgacgtggacctgggcgacatcagcgggatcaacgcctccgtcgtgaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtcatggtgaccatcatgctctgctgcatgacctcctgctgcagctgcctgaagggctgctgctcctgcgggagctgctgcaagttcgacgaggacgactccgagccggtgctgaagggcgtcaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23540 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_N501Y_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23541 - RNA, 4088 nt, synthetic construct
  misc_feature 1..4088: note = SARS-CoV-2/Wuhan/WIV05/2019__EPI_ISL_402128 spike protein mRNA gc (1-1273)(K986P_V987P_H69del_V70del_D614G)
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtggcctactccaacaacagcatcgccatccccaccaacttcacgatctccgtcaccaccgagatcctgcccgtgagcatgaccaagacgagcgtggactgcaccatgtacatctgcggcgactccaccgagtgcagcaacctcctgctgcagtacgggtccttctgcacccagctcaaccgcgcgctgacgggcatcgccgtcgagcaggacaagaacacccaggaggtgttcgcccaggtgaagcagatctacaagacgcccccgatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtcctctacgagaaccagaagctgatcgccaaccagttcaacagcgccatcgggaagatccaggactccctgagctccaccgccagcgcgctcggcaagctgcaggacgtggtgaaccagaacgcccaggccctgaacacgctcgtcaagcagctgtccagcaacttcggggccatctccagcgtgctgaacgacatcctctcccgcctggacccgcccgaggccgaggtgcagatcgaccggctgatcaccggccgcctccagagcctgcagacctacgtcacccagcagctgatccgggcggccgagatccgcgccagcgccaacctcgccgcgaccaagatgtccgagtgcgtgctgggccagagcaagcgggtggacttctgcgggaagggctaccacctgatgtccttcccccagagcgcgccccacggggtcgtgttcctccacgtgacgtacgtccccgcccaggagaagaacttcaccaccgccccggccatctgccacgacggcaaggcccacttcccccgcgagggggtgttcgtctccaacggcacccactggttcgtgacgcagcggaacttctacgagccccagatcatcaccaccgacaacaccttcgtgagcggcaactgcgacgtcgtgatcgggatcgtgaacaacacggtctacgaccccctgcagccggagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtgatggtcaccatcatgctctgctgcatgaccagctgctgctcctgcctgaagggctgctgcagctgcgggtcctgctgcaagttcgacgaggacgacagcgagccggtgctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23542 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_Y453F_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23543 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_D614G_I692V)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcgtcatcgcctacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgcgctgacgggcatcgccgtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtcctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtgctctacgagaaccagaagctgatcgccaaccagttcaacagcgccatcgggaagatccaggactccctgagctccaccgccagcgcgctcggcaagctgcaggacgtcgtgaaccagaacgcccaggccctgaacacgctcgtgaagcagctgtccagcaacttcggggccatctccagcgtcctgaacgacatcctctcccgcctggacccgcccgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgcgccccacggggtggtcttcctccacgtgacgtacgtccccgcccaggagaagaacttcaccaccgccccggccatctgccacgacggcaaggcccacttcccccgcgagggggtgttcgtgtccaacggcacccactggttcgtcacgcagcggaacttctacgagccccagatcatcaccaccgacaacaccttcgtgagcggcaactgcgacgtggtcatcgggatcgtgaacaacacggtgtacgaccccctgcagccggagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccctggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagccggtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23544 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_D614G_M1229I)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatcgtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23545 - RNA, 4088 nt, synthetic construct
  misc_feature 1..4088: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgtcctcgagcccctggtggacctgcccatcggcatcaacatcacccgcttccagaccctcctggccctgcaccggtcctacctcacgccgggggacagcagctccggctggaccgccggcgcggccgcctactacgtggggtacctgcagccccgcaccttcctgctcaagtacaacgagaacggcaccatcacggacgccgtcgactgcgcgctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggccgactacagcgtgctgtacaactccgcgagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcctggaacagcaacaacctcgactccaaggtcgggggcaactacaactacctgttccgcctgttccgcaagagcaacctcaagcccttcgagcgggacatctccaccgagatctaccaggcgggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgccgtccgcgacccccagaccctggagatcctcgacatcaccccctgcagcttcggcggggtgagcgtgatcacgccgggcaccaacacctccaaccaggtcgcggtgctgtaccagggcgtgaactgcaccgaggtccccgtggccatccacgccgaccagctgacgcccacctggcgggtgtacagcaccgggtccaacgtcttccagacccgcgccggctgcctcatcggggccgagcacgtgaacaacagctacgagtgcgacatccccatcggcgcgggcatctgcgcctcctaccagacgcagaccaacagcccgcggcgcgcccggtccgtggccagccagtccgtcatcgcgtacaccatgagcctgggggccgagaactccgtggcctacagcaacaactccatcgccatccccaccaacttcacgatcagcgtgaccaccgagatcctgcccgtctccatgaccaagacgagcgtggactgcaccatgtacatctgcggcgacagcaccgagtgctccaacctcctgctgcagtacgggagcttctgcacccagctcaaccgcgccctgacgggcatcgcggtggagcaggacaagaacacccaggaggtcttcgcccaggtgaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacacctccgccctcctggccggcaccatcacgagcgggtggaccttcggcgcgggcgccgccctgcagatccccttcgccatgcagatggcgtaccggttcaacgggatcggcgtgacccagaacgtgctctacgagaaccagaagctgatcgccaaccagttcaactccgccatcgggaagatccaggacagcctgtccagcaccgcctccgccctcggcaagctgcaggacgtcgtgaaccagaacgcgcaggccctgaacacgctcgtgaagcagctgagctccaacttcggggccatcagctccgtcctgaacgacatcctcagccgcctggacccgcccgaggccgaggtgcagatcgaccggctgatcaccggccgcctccagtccctgcagacctacgtgacccagcagctgatccgggccgcggagatccgcgccagcgccaacctcgccgccaccaagatgagcgagtgcgtcctgggccagtccaagcgggtggacttctgcgggaagggctaccacctgatgagcttcccccagtccgcgccccacggggtggtcttcctccacgtgacgtacgtccccgcccaggagaagaacttcaccaccgccccggccatctgccacgacggcaaggcgcacttcccccgcgagggggtgttcgtgagcaacggcacccactggttcgtcacgcagcggaacttctacgagccccagatcatcaccaccgacaacaccttcgtgtccggcaactgcgacgtggtcatcgggatcgtgaacaacacggtgtacgaccccctgcagccggagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccctggtacatctggctgggcttcatcgccgggctgatcgccatcgtgatggtgaccatcatgctctgctgcatgacctcctgctgcagctgcctgaagggctgctgctcctgcgggagctgctgcaagttcgacgaggacgactccgagccggtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23546 - RNA, 4088 nt, synthetic construct
  misc_feature 1..4088: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcgtgatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatcgtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23547 - RNA, 4085 nt, synthetic construct
  misc_feature 1..4085: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4085: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgacgacacgaccgacgccgtgcgcgacccccagaccctggagatcctcgacatcaccccctgcagcttcggcggggtctccgtgatcacgccgggcaccaacaccagcaaccaggtggcggtcctgtaccagggcgtgaactgcaccgaggtgcccgtcgccatccacgccgaccagctgacgcccacctggcgggtgtactccaccgggagcaacgtgttccagacccgcgccggctgcctcatcggggccgagcacgtcaacaactcctacgagtgcgacatccccatcggcgcgggcatctgcgccagctaccagacgcagaccaactcccaccggcgcgcccggagcgtggcctcccagagcatcatcgcgtacaccatgtccctgggggccgagaacagcgtggcctactccaacaacagcatcgccatcccgatcaacttcaccatctccgtcacgaccgagatcctgcccgtgagcatgaccaagaccagcgtggactgcacgatgtacatctgcggcgactccaccgagtgcagcaacctcctgctgcagtacgggtccttctgcacccagctcaaccgcgccctgaccggcatcgcggtcgagcaggacaagaacacgcaggaggtgttcgcccaggtgaagcagatctacaagaccccgcccatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgccgcgcgcgacctgatctgcgcccagaagttcaacgggctgaccgtgctgcccccgctcctgacggacgagatgatcgcccagtacaccagcgccctcctggccggcaccatcacctccgggtggacgttcggcgcgggcgccgccctgcagatccccttcgccatgcagatggcgtaccggttcaacgggatcggcgtgacccagaacgtcctctacgagaaccagaagctgatcgccaaccagttcaacagcgccatcgggaagatccaggactccctgagctccaccgccagcgccctcggcaagctgcaggacgtggtgaaccagaacgcgcaggccctgaacaccctcgtcaagcagctgtccagcaacttcggggccatctccagcgtgctgaacgacatcctcgcccgcctggacccgcccgaggccgaggtgcagatcgaccggctgatcacgggccgcctccagtccctgcagacctacgtcacccagcagctgatccgggcggccgagatccgcgccagcgccaacctcgccgcgaccaagatgagcgagtgcgtgctgggccagtccaagcgggtggacttctgcgggaagggctaccacctgatgagcttcccccagtccgcgccccacggggtcgtgttcctccacgtgacctacgtccccgcccaggagaagaacttcacgaccgcccccgccatctgccacgacggcaaggcccacttcccgcgcgagggggtgttcgtcagcaacggcacccactggttcgtgacccagcggaacttctacgagccccagatcatcacgacccacaacaccttcgtgtccggcaactgcgacgtcgtgatcgggatcgtgaacaacaccgtctacgaccccctgcagcccgagctggacagcttcaaggaggagctcgacaagtacttcaagaaccacacgtccccggacgtggacctgggcgacatcagcgggatcaacgcctccgtggtcaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtgatggtcaccatcatgctctgctgcatgacctcctgctgcagctgcctgaagggctgctgctcctgcgggagctgctgcaagttcgacgaggacgactccgagcccgtgctgaagggcgtgaagctccactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23548 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23549 - RNA, 4085 nt, synthetic construct
  misc_feature 1..4085: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4085: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacttcaccacccgcacgcagctcccgcccgcctacaccaacagcttcacccggggcgtctactaccccgacaaggtgttccgctccagcgtgctgcactccacccaggacctgttcctccccttcttcagcaacgtcacgtggttccacgccatccacgtgtccgggaccaacggcaccaagcggttcgcgaacccggtgctgcccttcaacgacggggtctacttcgccagcaccgagaagtccaacatcatccgcggctggatcttcgggacgaccctggacagcaagacccagtccctcctgatcgtgaacaacgccaccaacgtggtcatcaaggtgtgcgagttccagttctgcaacgaccccttcctgggcgtgtactaccacaagaacaacaagagctggatggagtccgagttccgggtctacagctccgccaacaactgcacgttcgagtacgtgagccagcccttcctcatggacctggagggcaagcaggggaacttcaagaacctgcgcgagttcgtgttcaagaacatcgacggctacttcaagatctactccaagcacaccccgatcaacctcgtccgggggctgccccagggcttcagcgccctggagcccctcgtggacctgcccatcgggatcaacatcacccgcttccagaccctgcacatctcctacctcacgccgggcgacagcagctccggctggaccgcgggggccgccgcctactacgtgggctacctgcagccccggaccttcctgctcaagtacaacgagaacgggaccatcacggacgcggtcgactgcgccctggaccccctgagcgagaccaagtgcaccctcaagtccttcaccgtggagaagggcatctaccagacgagcaacttccgcgtgcagcccaccgagtccatcgtccggttcccgaacatcaccaacctgtgccccttcggcgaggtgttcaacgccacccgcttcgccagcgtctacgcctggaaccggaagcgcatctccaactgcgtggcggactacagcgtgctgtacaactccgccagcttctccacgttcaagtgctacggggtcagccccaccaagctcaacgacctgtgcttcaccaacgtgtacgccgactccttcgtgatccggggcgacgaggtccgccagatcgcccccgggcagaccggcaacatcgccgactacaactacaagctgccggacgacttcacggggtgcgtgatcgcgtggaacagcaacaacctcgactccaaggtgggcggcaactacaactacctgtaccggctgttccgcaagagcaacctcaagcccttcgagcgggacatctccaccgagatctaccaggccgggagcaccccctgcaacggcgtcaaggggttcaactgctacttccccctgcagtcctacggcttccagccgacctacggggtgggctaccagccctaccgcgtggtcgtgctgagcttcgagctcctgcacgcccccgccacggtgtgcggccccaagaagtccaccaacctggtcaagaacaagtgcgtgaacttcaacttcaacgggctcaccggcaccggggtgctgaccgagagcaacaagaagttcctgccgttccagcagttcggccgggacatcgccgacacgaccgacgcggtccgcgacccccagaccctcgagatcctggacatcaccccctgcagcttcgggggcgtgtccgtgatcacgccgggcaccaacaccagcaaccaggtcgccgtgctgtaccagggggtgaactgcaccgaggtccccgtggccatccacgccgaccagctgacgcccacctggcgcgtgtactccaccggcagcaacgtcttccagacccgggccgggtgcctcatcggcgcggagcacgtgaacaactcctacgagtgcgacatccccatcggcgccgggatctgcgccagctaccagacgcagaccaactccccgcgccgggcccgcagcgtggcgtcccagagcatcatcgcctacaccatgtccctgggcgtcgagaacagcgtggcctactccaacaacagcatcgccatccccaccaacttcacgatctccgtgaccaccgagatcctgcccgtcagcatgaccaagacgagcgtggactgcaccatgtacatctgcggggactccaccgagtgcagcaacctcctgctgcagtacggctccttctgcacccagctcaaccgggccctgacggggatcgcggtggagcaggacaagaacacccaggaggtcttcgcccaggtgaagcagatctacaagacgcccccgatcaaggacttcggcggcttcaacttcagccagatcctgcccgacccctccaagcccagcaagcgctccttcatcgaggacctcctgttcaacaaggtgaccctggccgacgccgggttcatcaagcagtacggcgactgcctcggggacatcgccgcgcgggacctgatctgcgcccagaagttcaacggcctgaccgtcctcccgcccctgctgaccgacgagatgatcgcccagtacaccagcgccctcctggccgggaccatcacgtccggctggaccttcggcgcgggggccgccctgcagatccccttcgccatgcagatggcgtaccgcttcaacggcatcggggtgacccagaacgtgctctacgagaaccagaagctgatcgccaaccagttcaacagcgccatcggcaagatccaggactccctgagctccaccgccagcgccctcgggaagctgcaggacgtcgtgaaccagaacgcgcaggccctgaacacgctcgtgaagcagctgtccagcaacttcggcgccatctccagcgtcctgaacgacatcctctcccggctggacccgcccgaggccgaggtgcagatcgaccgcctgatcaccggccggctccagagcctgcagacctacgtgacccagcagctgatccgcgccgcggagatccgggccagcgccaacctcgccgccaccaagatgtccgagtgcgtcctggggcagagcaagcgcgtggacttctgcggcaaggggtaccacctgatgtccttcccccagagcgcgccccacggcgtggtcttcctccacgtgacgtacgtccccgcccaggagaagaacttcaccaccgccccggccatctgccacgacgggaaggcgcacttcccccgggagggcgtgttcgtgtccaacggcacccactggttcgtcacgcagcgcaacttctacgagccccagatcatcaccaccgacaacaccttcgtgagcgggaactgcgacgtggtcatcggcatcgtgaacaacacggtgtacgaccccctgcagccggagctggactccttcaaggaggagctcgacaagtacttcaagaaccacaccagccccgacgtcgacctgggggacatctccggcatcaacgccagcgtggtgaacatccagaaggagatcgaccggctgaacgaggtcgccaagaacctcaacgagtccctgatcgacctgcaggagctcggcaagtacgagcagtacatcaagtggccctggtacatctggctggggttcatcgccggcctgatcgccatcgtgatggtgaccatcatgctctgctgcatgaccagctgctgctcctgcctgaaggggtgctgcagctgcggctcctgctgcaagttcgacgaggacgacagcgagccggtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23550 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_K986P_V987P_E484K_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23551 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacttcaccaaccgcacccagctcccgagcgcctacacgaactccttcacccggggcgtctactaccccgacaaggtgttccgcagctccgtgctgcacagcacccaggacctgttcctccccttcttctccaacgtcacctggttccacgccatccacgtgagcgggacgaacggcaccaagcggttcgacaaccccgtgctgccgttcaacgacggggtctacttcgcgtccaccgagaagtccaacatcatccgcggctggatcttcgggaccacgctggactccaagacccagagcctcctgatcgtgaacaacgccaccaacgtggtcatcaaggtgtgcgagttccagttctgcaactaccccttcctgggcgtgtactaccacaagaacaacaagtcctggatggagagcgagttccgggtctactccagcgccaacaactgcaccttcgagtacgtgtcccagcccttcctcatggacctggagggcaagcaggggaacttcaagaacctgagcgagttcgtgttcaagaacatcgacggctacttcaagatctactccaagcacacgcccatcaacctcgtccgcgacctgccgcaggggttcagcgccctggagcccctcgtggacctgcccatcggcatcaacatcacccggttccagaccctgctcgccctgcaccgcagctacctgacccccggggactccagctccggctggacggcgggcgccgccgcctactacgtggggtacctccagccgcggaccttcctgctgaagtacaacgagaacggcaccatcaccgacgcggtcgactgcgccctcgaccccctgagcgagacgaagtgcaccctgaagtccttcaccgtggagaaggggatctaccagaccagcaacttccgcgtgcagcccacggagtccatcgtccggttccccaacatcaccaacctctgcccgttcggcgaggtgttcaacgccacccgcttcgccagcgtctacgcctggaaccggaagcgcatctccaactgcgtggcggactacagcgtgctgtacaactccgccagcttctccaccttcaagtgctacggcgtcagccccacgaagctgaacgacctctgcttcaccaacgtgtacgccgactccttcgtgatccgcggggacgaggtccggcagatcgcccccggccagaccgggaccatcgccgactacaactacaagctgcccgacgacttcacgggctgcgtgatcgcgtggaacagcaacaacctggactccaaggtcgggggcaactacaactacctctaccggctgttccgcaagagcaacctgaagccgttcgagcgggacatctccaccgagatctaccaggccggcagcaccccctgcaacggggtgaagggcttcaactgctacttccccctccagagctacgggttccagcccacctacggcgtggggtaccagccgtaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgcccttccagcagttcgggcgggacatcgccgacacgaccgacgcggtccgcgacccgcagaccctggagatcctggacatcaccccctgcagcttcggcggggtgtccgtgatcacgcccggcaccaacaccagcaaccaggtcgccgtgctctaccagggcgtgaactgcaccgaggtcccggtggccatccacgccgaccagctgacgcccacctggcgcgtgtactccaccgggagcaacgtcttccagacccgggccggctgcctgatcggggcggagtacgtgaacaactcctacgagtgcgacatccccatcggcgccggcatctgcgccagctaccagacgcagaccaacagcccccgccgggcccgcagcgtggcgtcccagagcatcatcgcctacaccatgtccctcggggccgagaacagcgtcgcctactccaacaacagcatcgccatcccgaccaacttcacgatcagcgtgaccaccgagatcctgcccgtgtccatgaccaagacgagcgtcgactgcaccatgtacatctgcggcgactccaccgagtgcagcaacctgctcctgcagtacgggtccttctgcacccagctgaaccgggcgctcacgggcatcgccgtggagcaggacaagaacacccaggaggtgttcgcccaggtcaagcagatctacaagaccccgcccatcaaggacttcgggggcttcaacttcagccagatcctgcccgacccctccaagcccagcaagcgctccttcatcgaggacctcctgttcaacaaggtgaccctggccgacgccggcttcatcaagcagtacggggactgcctgggcgacatcgcggcccgggacctcatctgcgcccagaagttcaacgggctgacggtgctgcccccgctcctgaccgacgagatgatcgcccagtacaccagcgccctgctcgcgggcaccatcacgtccgggtggaccttcggcgccggcgccgccctgcagatccccttcgcgatgcagatggcctaccgcttcaacgggatcggcgtcacccagaacgtgctgtacgagaaccagaagctcatcgccaaccagttcaacagcgccatcgggaagatccaggactccctgagctccaccgccagcgcgctgggcaagctccaggacgtggtcaaccagaacgcccaggccctgaacacgctggtgaagcagctctccagcaacttcggggccatctccagcgtgctgaacgacatcctgagccggctcgacccgcccgaggccgaggtccagatcgaccgcctgatcaccggccggctgcagtccctccagacctacgtgacccagcagctgatccgcgcggccgagatccgggccagcgccaacctggccgcgatcaagatgtccgagtgcgtgctcggccagagcaagcgcgtcgacttctgcgggaagggctaccacctgatgtccttcccccagagcgcgccccacggggtggtgttcctgcacgtcacctacgtgcccgcccaggagaagaacttcacgaccgcccccgccatctgccacgacggcaaggcccacttcccgcgggagggggtcttcgtgtccaacggcacccactggttcgtgacccagcgcaacttctacgagccccagatcatcacgaccgacaacaccttcgtcagcggcaactgcgacgtggtgatcgggatcgtcaacaacaccgtgtacgaccccctccagcccgagctggactccttcaaggaggagctggacaagtacttcaagaaccacacgagcccggacgtggacctcggcgacatctccgggatcaacgccagcgtcgtgaacatccagaaggagatcgaccggctgaacgaggtggccaagaacctgaacgagtccctcatcgacctgcaggagctgggcaagtacgagcagtacatcaagtggccctggtacatctggctcggcttcatcgccgggctgatcgcgatcgtcatggtgaccatcatgctgtgctgcatgaccagctgctgctcctgcctcaagggctgctgcagctgcgggtcctgctgcaagttcgacgaggacgacagcgagcccgtgctgaagggcgtcaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23552 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagcatccagtgcgtgaacctcaccacccgcacgcagctgccgcccgcctacaccaactccttcacccggggcgtctactaccccgacaaggtgttccgcagctccgtgctgcacagcacccaggacctcttcctgcccttcttctccaacgtcacgtggttccacgccatccacgtgagcgggaccaacggcaccaagcggttcgacaacccggtgctgcccttcaacgacggggtctacttcgcgtccaccgagaagtccaacatcatccgcggctggatcttcgggacgaccctcgacagcaagacccagagcctgctgatcgtgaacaacgccaccaacgtggtcatcaaggtgtgcgagttccagttctgcaacgaccccttcctcggcgtgtactaccacaagaacaacaagtcctgcatggagagcgagttccgggtctactccagcgccaacaactgcacgttcgagtacgtgtcccagcccttcctgatggacctggagggcaagcaggggaacttcaagaacctccgcgagttcgtgttcaagaacatcgacggctacttcaagatctacagcaagcacaccccgatcaacctggtccgggacctgccccaggggttctccgccctcgagcccctggtggacctgcccatcggcatcaacatcacccgcttccagaccctcctggccctgcaccggagctacctcacgccgggggactccagcagcggctggaccgcgggcgccgccgcctactacgtggggtacctgcagccccgcaccttcctgctcaagtacaacgagaacggcaccatcacggacgcggtcgactgcgccctggaccccctgtccgagaccaagtgcaccctcaagagcttcaccgtggagaaggggatctaccagacgtccaacttccgggtgcagcccaccgagagcatcgtccgcttcccgaacatcaccaacctgtgccccttcggcgaggtgttcaacgccacccggttcgcctccgtctacgcctggaaccgcaagcggatcagcaactgcgtggcggactactccgtgctgtacaacagcgcctccttcagcacgttcaagtgctacggcgtctcccccaccaagctcaacgacctgtgcttcaccaacgtgtacgccgacagcttcgtgatccgcggggacgaggtccggcagatcgcccccggccagaccgggaagatcgccgactacaactacaagctgccggacgacttcacgggctgcgtgatcgcgtggaactccaacaacctcgacagcaaggtcgggggcaactacaactaccgctaccggctgttccgcaagtccaacctgaagcccttcgagcgggacatcagcaccgagatctaccaggccggctccaccccctgcaacggggtggagggcttcaactgctacttccccctccagagctacgggttccagccgaccaacggcgtggggtaccagccctaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgccgttccagcagttcgggcgcgacatcgccgacacgaccgacgcggtccgggacccccagaccctggagatcctggacatcaccccctgcagcttcggcggggtgagcgtgatcacgccgggcaccaacacctccaaccaggtcgccgtgctctaccagggcgtgaactgcaccgaggtccccgtggccatccacgccgaccagctgacgcccacctggcgcgtgtacagcaccgggtccaacgtcttccagacccgggccggctgcctgatcggggcggagcacgtgaacaacagctacgagtgcgacatccccatcggcgccggcatctgcgcctcctaccagacgcagaccaacagcccgcgccgggcccgctccgtggcgagccagtccatcatcgcctacaccatgagcctcggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctgctcctgcagtacgggagcttctgcacccagctgaaccgggcgctcacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcgcagcttcatcgaggacctcctgttcaacaaggtgaccctggccgacgccggcttcatcaagcagtacggggactgcctgggcgacatcgcggcccgggacctcatctgcgcccagaagttcaacgggctgaccgtgctgccgcccctcctgaccgacgagatgatcgcccagtacacctccgccctgctcgcgggcaccatcacgagcgggtggaccttcggcgccggcgccgccctgcagatccccttcgcgatgcagatggcctaccgcttcaacgggatcggcgtcacccagaacgtgctgtacgagaaccagaagctcatcgccaaccagttcaactccgccatcgggaagatccaggacagcctgtccagcaccgcctccgcgctgggcaagctccaggacgtggtcaaccagaacgcccaggccctgaacacgctggtgaagcagctcagctccaacttcggggccatcagctccgtgctgaacgacatcctgagccggctcgacccgcccgaggccgaggtccagatcgaccgcctgatcaccggccggctgcagtccctccagacctacgtgacccagcagctgatccgcgcggccgagatccgggccagcgccaacctggccgcgaccaagatgagcgagtgcgtgctcggccagtccaagcgcgtcgacttctgcgggaagggctaccacctgatgagcttcccccagtccgcgccccacggggtggtgttcctgcacgtcacgtacgtgcccgcccaggagaagaacttcaccaccgccccggccatctgccacgacggcaaggcccacttcccccgggagggggtcttcgtgagcaacggcacccactggttcgtgacgcagcgcaacttctacgagccccagatcatcaccaccgacaacaccttcgtctccggcaactgcgacgtggtgatcgggatcgtcaacaacacggtgtacgaccccctccagccggagctggacagcttcaaggaggagctggacaagtacttcaagaaccacacctcccccgacgtggacctcggcgacatcagcgggatcaacgcctccgtcgtgaacatccagaaggagatcgaccggctgaacgaggtggccaagaacctgaacgagagcctcatcgacctgcaggagctgggcaagtacgagcagtacatcaagtggccctggtacatctggctcggcttcatcgccgggctgatcgcgatcgtcatggtgaccatcatgctgtgctgcatgacctcctgctgcagctgcctcaagggctgctgctcctgcgggagctgctgcaagttcgacgaggacgactccgagccggtgctgaagggcgtcaagctgcactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23553 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccaggacgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23554 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_ D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23555 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_A222V_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23556 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_N439K_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaagaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23557 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_S477N_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23558 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_N501Y_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23559 - RNA, 4088 nt, synthetic construct
  misc_feature 1..4088: note = SARS-CoV-2/Wuhan/WIV05/2019__EPI_ISL_402128 spike protein mRNA gc (1-1273)(K986P_V987P_H69del_V70del_D614G)
  source 1..4088: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23560 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_Y453F_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23561 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_D614G_I692V)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23562 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_D614G_M1229I)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23563 - RNA, 4088 nt, synthetic construct
  misc_feature 1..4088: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4088: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23564 - RNA, 4088 nt, synthetic construct
  misc_feature 1..4088: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4088: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23565 - RNA, 4085 nt, synthetic construct
  misc_feature 1..4085: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4085: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgacgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcacaccggagggcaaggagcgtggccagccagagcatcatcgcctacaccatgagcctgggcgccgagaacagcgtggcctacagcaacaacagcatcgccatccccatcaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctggcccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23566 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23567 - RNA, 4085 nt, synthetic construct
  misc_feature 1..4085: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4085: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacttcaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgccaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcggggcctgccccagggcttctcagccctggagcccctggtggacctgcccatcggcatcaacatcacccggttccagaccctgcacatcagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgtggagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23568 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_K986P_V987P_E484K_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23569 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacttcaccaaccggacccagctgccaagcgcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaactaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgagcgagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaccatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagtacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccatcaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23570 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcatccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctgcatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactaccgctaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23571 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccaggacgtgaactgcaccgaggtgcccgtggccatccacgccgaccagctgacccccacctggcgggtgtacagcaccggaagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgattgcctgggcgacatcgccgctcgggacctgatctgcgcccagaagttcaacgggctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggcgtgttcgtgagcaacggaacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23572 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_ D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23573 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_A222V_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtcagcgtgatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagcccccggcgggcccggagcgtggccagccagagcatcatcgcctacaccatgagcttaggcgccgagaacagcgtggcctacagcaacaacagcatcgccatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttttgcggcaagggctaccacctgatgagcttcccccagagcgctccccacggcgtggtgttcctccacgtcacatacgtgcccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23574 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_N439K_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaagaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggatcccccagaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23575 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_S477N_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcaacaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgcgcctcctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaatttcggcgccatcagcagcgtgctgaacgacatcctgtcaaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23576 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_N501Y_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggatcccccagaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23577 - RNA, 4088 nt, synthetic construct
  misc_feature 1..4088: note = SARS-CoV-2/Wuhan/WIV05/2019__EPI_ISL_402128 spike protein mRNA gc (1-1273)(K986P_V987P_H69del_V70del_D614G)
  source 1..4088: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtgcccgcccaggagaagaacttcaccaccgcccccgccatttgccacgacggcaaggcccacttcccccgggagggagtcttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23578 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_Y453F_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23579 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_D614G_I692V)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtcacatacgtgcccgcccaggagaagaacttcaccaccgcccccgccatctgccacgacggcaaggcccacttcccccgggagggagtgttcgtgagcaacggcacccactggttcgtgacccagcggaacttctacgagcctcagattatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23580 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_D614G_M1229I)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23581 - RNA, 4088 nt, synthetic construct
  misc_feature 1..4088: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4088: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcaacaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtgagcgtcatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgccggcatctgcgcttcctaccagacccagaccaacagcccccggcgggcccggagcgtggccagccagagcgtgatcgcctacaccatgagcttaggcgccgagaacagcgtggcctacagcaacaacagcatcgccatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaattttggcgccatcagcagcgtgctgaacgacatcctgtcaaggctggatcccccagaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttctgcggcaagggctaccacctgatgagcttcccccagagcgctccccacggcgtggtgttcctccacgtcacatacgtgcccgcccaggagaagaacttcaccaccgcccccgccatctgccacgacggcaaggcccacttcccccgggagggagtgttcgtgagcaacggcacccactggttcgtgacccagcggaacttctacgagcctcagattatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23582 - RNA, 4088 nt, synthetic construct
  misc_feature 1..4088: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4088: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgctccccacggcgtggtgttcctccacgtgacatacgtccccgcccaggagaagaacttcaccaccgcccccgccatctgccacgacggcaaggcccacttcccccgggagggagtgttcgtgagcaacggcacccactggttcgtgacccagcggaacttctacgagcctcagattatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23583 - RNA, 4085 nt, synthetic construct
  misc_feature 1..4085: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4085: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgacgacaccaccgacgccgtgcgggacccccagaccctggagatcctggacatcaccccatgcagcttcggcggcgtgagcgtgatcacccccggcacaaacaccagcaaccaggtcgcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagccaccggcgggcccggagcgtggccagccagagcatcatcgcctacaccatgagcttaggcgccgagaacagcgtggcctacagcaacaacagcatcgccatccccatcaacttcaccataagcgtgaccaccgagatcctgcctgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagaccccacccatcaaggacttcggcggcttcaacttcagccagatcctgcccgaccccagcaagcccagcaagcggagcttcatcgaggacctgctgttcaacaaggtgactctggccgacgccggcttcatcaagcagtacggcgattgcctgggggacatcgccgcccgggacctgatctgcgctcagaagttcaacggcctgaccgtgctgcctcccctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaacgacatcctggccaggctggacccacccgaggccgaggtgcagatcgaccggctgatcaccggccggctgcagagcctgcagacctacgtgacccagcagctgatccgggccgccgagattcgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacctacgtgcccgcccaggagaagaacttcacaaccgcccccgccatctgccacgacggcaaggcccacttcccccgggagggagtcttcgtgagcaacggcacccactggttcgtgacccagcggaacttctacgagccccagatcatcaccacccacaacaccttcgtgagcggcaactgcgacgtggtgatcggcatcgtgaacaacaccgtgtacgaccctctgcagcccgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccatggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23584 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23585 - RNA, 4085 nt, synthetic construct
  misc_feature 1..4085: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4085: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacttcaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgccaacccagtgctgcccttcaacgacggcgtgtacttcgccagcaccgagaagtcaaacatcatccggggctggatctttggcaccaccctggacagcaagacacagagcctgctgatcgtgaacaacgctaccaacgtggtgatcaaggtgtgcgagttccagttctgcaacgaccccttcctgggcgtgtactaccacaagaacaacaagagctggatggagagcgagttccgggtctacagcagcgccaacaattgcaccttcgagtacgtgagccagcccttcctgatggacctggagggcaagcagggcaacttcaagaacctccgggagttcgtgttcaagaacatcgacggctacttcaagatctacagcaagcacacccccatcaacctggtgcggggactgccccagggcttcagcgccctggagcctctggtggatctgcccatcggcatcaacatcaccaggttccagaccctgcacatcagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcacccttaagagcttcaccgtggagaagggcatctaccagaccagcaacttccgggtgcagcccactgagagcattgtgcggttccccaacatcaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctattccgtaagagcaacctgaagccatttgagcgggacatcagcaccgagatctaccaggccggtagcaccccctgcaacggcgtgaagggcttcaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggacatcgccgacaccaccgatgcagtgcgggacccccagaccctggagatcctggacatcaccccatgcagcttcggcggcgtgagcgtcatcacccccggaacaaacaccagcaaccaggtggccgtgctgtaccagggcgtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcctgggcgtggagaacagcgtggcctacagcaacaacagcatcgccatccctaccaacttcaccataagcgtgaccaccgagatcctgcccgtgagcatgaccaagaccagcgtggactgtaccatgtacatctgcggcgacagcaccgagtgcagcaacctgttactgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggggactgcctgggcgacatcgccgcccgggacctgatctgcgctcagaagttcaacggcctgaccgtgctgccccctctgctgaccgatgagatgatcgcccagtacaccagcgccctgctggccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaactttggcgccatcagctcagtgctgaatgacatcctgagccggctggatcccccagaggccgaggtgcagatcgacaggctgatcaccggccggctgcagagcctgcagacctacgtgacccagcagctgatccgggccgccgagattcgggccagcgccaacctggccgcaaccaagatgagcgagtgcgtgctgggccagagcaagcgggtggacttctgcggcaagggctaccacctgatgagcttcccccagagcgctccccacggcgtggtgttcctgcacgtcacatacgtgcccgcccaggagaagaacttcaccaccgcccccgccatctgccacgacggaaaggcccacttcccccgggagggcgtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctcgacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23586 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_K986P_V987P_E484K_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23587 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacttcaccaaccggacccagctgcccagcgcctacaccaacagcttcacccggggcgtgtactaccctgacaaggtgttccggagcagcgtgctgcacagcacccaggacctgttcctgcccttcttcagcaacgtgacctggttccacgccatccacgtgagcggcaccaacggcaccaagcggttcgacaaccccgtgctgccattcaacgacggcgtgtacttcgccagcaccgagaagtcaaacatcatccggggctggatctttggcaccaccctggacagcaagacccagagcctgctgatcgtgaacaacgccacaaacgtggtgatcaaggtgtgcgagttccagttctgcaactaccccttcctgggcgtgtactaccacaagaacaacaagagctggatggagagcgagttccgggtctacagcagcgctaataactgcaccttcgagtacgtgagccagcccttcctgatggacctggagggcaagcagggcaacttcaagaacctcagcgagttcgtgttcaagaacatcgacggctacttcaagatctacagcaagcacacccccatcaacctggtgcgggatctgccccagggattcagcgccctggagcccctggtggacctgcctatcggcatcaacatcacccggttccagaccctgctggccctgcacaggagctacctgacccccggcgacagcagcagcggctggaccgccggcgccgccgcatactacgtgggctacctgcagccccggaccttcctgctgaagtacaacgagaacggcaccatcaccgacgccgtggactgcgccctggacccactgagcgagaccaagtgcaccctaaagagcttcaccgtggagaagggcatctaccagaccagcaacttccgggtgcagcccaccgagagcatcgtgcggttccccaacattactaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgctgacagcttcgtgatccggggcgacgaggtgcggcagatcgcccctggccagaccggcaccatcgccgactacaactacaagctgcccgacgacttcaccggctgcgtgatcgcctggaacagcaacaacctggacagcaaggtgggcggcaactacaactacctgtaccggctgttccgtaagagcaacctgaagccctttgagcgggacatcagcaccgagatctaccaggccggcagcaccccatgcaacggtgtgaagggcttcaactgctacttccccctgcagagctacggcttccagcccacctacggcgtgggctaccagccctaccgggtggtggtgctgagcttcgagctgctgcacgcccccgccaccgtgtgcggccccaaaaagagcaccaacctggtgaagaacaagtgcgtgaacttcaatttcaacggcctgaccggcaccggcgtgctgaccgagagcaacaagaagttcctgcctttccagcagttcggccgggacatcgccgataccaccgacgcagtgcgggacccccagaccctggagatcctggacatcaccccctgcagcttcggcggcgtgagcgtcatcaccccaggcacaaacaccagcaaccaggtggccgtgctgtaccagggagtgaactgcaccgaggtgcccgtggccatccacgccgaccagctgacccccacctggcgggtgtactccaccggcagcaacgtgttccagacccgggccggctgcctgatcggcgccgagtacgtgaacaacagctacgagtgcgacatccccatcggcgctggcatctgcgccagctaccagacccagaccaacagcccccggcgggcccggagcgtggccagccagagcatcatcgcctacaccatgagcctgggcgccgagaacagcgtggcctacagcaacaacagcatcgcgatccccaccaacttcaccatcagcgtgaccaccgagatattacctgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactccacccatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggacatcgccgctcgggatctgatctgcgcccagaagttcaacggcctgaccgtgctgcctcccctgctgaccgacgagatgatcgcccagtacaccagcgccctgctggccggcaccatcaccagcggctggaccttcggcgccggcgcagcccttcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagctcaaactttggcgccatcagcagcgtgctgaatgacatcctgagccggctggacccacccgaggccgaggtgcagatcgacaggctgatcaccggccggctgcagagcctgcagacctacgtgacccagcagctgatccgggccgccgagatccgggccagcgccaacctggcagccattaagatgagcgagtgcgtgctgggccagagcaagcgggtggacttctgcggcaagggctaccacctgatgagcttcccccagagcgctccccacggcgtggtgttcctgcacgtgacctacgtccccgcccaggagaagaacttcacaaccgcccccgccatctgccacgacggcaaggcccacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccctctccagcccgagctggacagcttcaaggaggagctggacaagtacttcaagaaccacaccagccccgacgtggacctgggcgatatcagcggcatcaacgccagcgtggtgaacatccagaaggagatcgaccggctgaacgaggtggccaagaacctgaacgagagcctgatcgacctgcaggagctgggcaagtacgagcagtacatcaagtggccatggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23588 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcatccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctgcatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgtaccctaaagagcttcaccgtggagaagggcatctaccagaccagcaacttccgggtgcagcccactgagagcattgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactaccggtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgtgcctcctaccagacccagaccaacagcccccggcgggcccggagcgtggccagccagagcatcatcgcctacaccatgagcctgggcgccgagaacagcgtggcctacagcaacaacagcatcgcgatccctaccaacttcaccataagcgtgaccaccgagatcttacccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgctggccggcaccatcaccagcggctggaccttcggcgccggcgcagcccttcagatccccttcgccatgcagatggcctacaggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagcagcgtgctgaatgacatcctgtcacggctggatcccccagaggccgaggtgcagatcgaccggctgatcaccggccggctgcagagcctgcagacctacgtgacccagcagctgatccgggccgccgagattcgggccagcgccaacctggcagccaccaagatgagcgagtgcgtgctgggccagagcaagcgggtggacttttgcggcaagggctaccacctgatgagcttcccccagagcgctccccacggcgtggtgttcctgcacgtgacatacgtccccgcccaggagaagaacttcaccaccgcccccgccatctgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctccagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgttgcagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23589 - RNA, 4094 nt, synthetic construct; identical to SEQ ID NO: 151
  misc_feature 1..4094: note = SARS-CoV-2/Wuhan/WIV05/2019__EPI_ISL_402128 spike protein mRNA gc mod (1-1273)(K986P_V987P) R10162
  source 1..4094: mol_type = other RNA

SEQ ID NO: 23590 - RNA, 4094 nt, synthetic construct
  misc_feature 1..4094: note = SARS-CoV-2/Wuhan/WIV05/2019__EPI_ISL_402128 spike protein mRNA gc mod (1-1273)(K986P_V987P_ D614G)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23591 - RNA, 4094 nt, synthetic construct
  misc_feature 1..4094: note = SARS-CoV-2/Wuhan/WIV05/2019__EPI_ISL_402128 spike protein mRNA gc mod (1-1273)(K986P_V987P_A222V_D614G)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23592 - RNA, 4094 nt, synthetic construct
  misc_feature 1..4094: note = SARS-CoV-2/Wuhan/WIV05/2019__EPI_ISL_402128 spike protein mRNA gc mod (1-1273)(K986P_V987P_N439K_D614G)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23593 - RNA, 4094 nt, synthetic construct
  misc_feature 1..4094: note = SARS-CoV-2/Wuhan/WIV05/2019__EPI_ISL_402128 spike protein mRNA gc mod (1-1273)(K986P_V987P_S477N_D614G)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23594 - RNA, 4094 nt, synthetic construct
  misc_feature 1..4094: note = SARS-CoV-2/Wuhan/WIV05/2019__EPI_ISL_402128 spike protein mRNA gc mod (1-1273)(K986P_V987P_N501Y_D614G)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23595 - RNA, 4088 nt, synthetic construct
  misc_feature 1..4088: note = SARS-CoV-2/Wuhan/WIV05/2019__EPI_ISL_402128 spike protein mRNA gc mod (1-1273)(K986P_V987P_H69del_V70del_D614G)
  source 1..4088: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23596 - RNA, 4094 nt, synthetic construct
  misc_feature 1..4094: note = SARS-CoV-2/Wuhan/WIV05/2019__EPI_ISL_402128 spike protein mRNA gc mod (1-1273)(K986P_V987P_Y453F_D614G)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23597 - RNA, 4094 nt, synthetic construct
  misc_feature 1..4094: note = SARS-CoV-2/Wuhan/WIV05/2019__EPI_ISL_402128 spike protein mRNA gc mod (1-1273)(K986P_V987P_D614G_I692V)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23598 - RNA, 4094 nt, synthetic construct
  misc_feature 1..4094: note = SARS-CoV-2/Wuhan/WIV05/2019__EPI_ISL_402128 spike protein mRNA gc mod (1-1273)(K986P_V987P_D614G_M1229I)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23599 - RNA, 4088 nt, synthetic construct
  misc_feature 1..4088: note = SARS-CoV-2/Wuhan/WIV05/2019__EPI_ISL_402128 spike protein mRNA gc mod (1-1273)(K986P_V987P_H69del_V70del_A222V_Y453F_S477N_D614G_ I692V)
  source 1..4088: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23600 - RNA, 4088 nt, synthetic construct
  misc_feature 1..4088: note = SARS-CoV-2/Wuhan/WIV05/2019__EPI_ISL_402128 spike protein mRNA gc mod (1-1273)(K986P_V987P_H69del_V70del_Y453F_D614G_I692V_M1229I )
  source 1..4088: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23601 - RNA, 4085 nt, synthetic construct
  misc_feature 1..4085: note = SARS-CoV-2/Wuhan/WIV05/2019__EPI_ISL_402128 spike protein mRNA gc mod (1-1273)(K986P_V987P_K986P_V987P_H69del_V70del_Y144del_N501 Y_A570D_D614G_P681H_T716I_S982A_D1118H)
  source 1..4085: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccacagacgggctagaagcgtggccagccagagcatcattgcctacacaatgtctctgggcgccgagaacagcgtggcctactccaacaactctatcgctatccccatcaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23602 - RNA, 4094 nt, synthetic construct
  misc_feature 1..4094: note = SARS-CoV-2/Wuhan/WIV05/2019__EPI_ISL_402128 spike protein mRNA gc mod (1-1273)(K986P_V987P_K986P_V987P_K417N_E484K_N501Y_D614G)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23603 - RNA, 4085 nt, synthetic construct
  misc_feature 1..4085: note = SARS-CoV-2/Wuhan/WIV05/2019__EPI_ISL_402128 spike protein mRNA gc mod (1-1273)(K986P_V987P_K986P_V987P_L18F_D80A_D215G_L242del_A2 43del_L244del_R246I_K417N_E484K_N501Y_D614G_A701V)
  source 1..4085: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacttcaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgtggagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23604 - RNA, 4094 nt, synthetic construct
  misc_feature 1..4094: note = SARS-CoV-2/Wuhan/WIV05/2019__EPI_ISL_402128 spike protein mRNA gc mod (1-1273)(K986P_V987P_K986P_V987P_E484K_D614G)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23605 - RNA, 4094 nt, synthetic construct
  misc_feature 1..4094: note = SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S _K417T_E484K_N501Y_D614G_H655Y_T1027I)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacttcaccaacagaacacagctgcctagcgcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23606 - RNA, 4094 nt, synthetic construct
  misc_feature 1..4094: note = SARS-CoV-2/Wuhan/WIV05/2019__EPI_ISL_402128 spike protein mRNA gc mod (1-1273)(K986P_V987P_K986P_V987P_S13I_W152C_L452R_D614G)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccatccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23607 - RNA, 4094 nt, synthetic construct
  misc_feature 1..4094: note = SARS-CoV-2/Wuhan/WIV05/2019__EPI_ISL_402128 spike protein mRNA gc mod (1-1273)(K986P_V987P)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23608 - RNA, 4094 nt, synthetic construct
  misc_feature 1..4094: note = SARS-CoV-2/Wuhan/WIV05/2019__EPI_ISL_402128 spike protein mRNA gc mod (1-1273)(K986P_V987P_ D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23609 - RNA, 4094 nt, synthetic construct
  misc_feature 1..4094: note = SARS-CoV-2/Wuhan/WIV05/2019__EPI_ISL_402128 spike protein mRNA gc mod (1-1273)(K986P_V987P_A222V_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23610 - RNA, 4094 nt, synthetic construct
  misc_feature 1..4094: note = SARS-CoV-2/Wuhan/WIV05/2019__EPI_ISL_402128 spike protein mRNA gc mod (1-1273)(K986P_V987P_N439K_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23611 - RNA, 4094 nt, synthetic construct
  misc_feature 1..4094: note = SARS-CoV-2/Wuhan/WIV05/2019__EPI_ISL_402128 spike protein mRNA gc mod (1-1273)(K986P_V987P_S477N_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23612 - RNA, 4094 nt, synthetic construct
  misc_feature 1..4094: note = SARS-CoV-2/Wuhan/WIV05/2019__EPI_ISL_402128 spike protein mRNA gc mod (1-1273)(K986P_V987P_N501Y_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23613 - RNA, 4088 nt, synthetic construct
  misc_feature 1..4088: note = SARS-CoV-2/Wuhan/WIV05/2019__EPI_ISL_402128 spike protein mRNA gc mod (1-1273)(K986P_V987P_H69del_V70del_D614G)
  source 1..4088: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23614 - RNA, 4094 nt, synthetic construct
  misc_feature 1..4094: note = SARS-CoV-2/Wuhan/WIV05/2019__EPI_ISL_402128 spike protein mRNA gc mod (1-1273)(K986P_V987P_Y453F_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23615 - RNA, 4094 nt, synthetic construct
  misc_feature 1..4094: note = SARS-CoV-2/Wuhan/WIV05/2019__EPI_ISL_402128 spike protein mRNA gc mod (1-1273)(K986P_V987P_D614G_I692V)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23616 - RNA, 4094 nt, synthetic construct
  misc_feature 1..4094: note = SARS-CoV-2/Wuhan/WIV05/2019__EPI_ISL_402128 spike protein mRNA gc mod (1-1273)(K986P_V987P_D614G_M1229I)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23617 - RNA, 4088 nt, synthetic construct
  misc_feature 1..4088: note = SARS-CoV-2/Wuhan/WIV05/2019__EPI_ISL_402128 spike protein mRNA gc mod (1-1273)(K986P_V987P_H69del_V70del_A222V_Y453F_S477N_D614G_ I692V)
  source 1..4088: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23618 - RNA, 4088 nt, synthetic construct
  misc_feature 1..4088: note = SARS-CoV-2/Wuhan/WIV05/2019__EPI_ISL_402128 spike protein mRNA gc mod (1-1273)(K986P_V987P_H69del_V70del_Y453F_D614G_I692V_M1229I )
  source 1..4088: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23619 - RNA, 4085 nt, synthetic construct
  misc_feature 1..4085: note = SARS-CoV-2/Wuhan/WIV05/2019__EPI_ISL_402128 spike protein mRNA gc mod (1-1273)(K986P_V987P_K986P_V987P_H69del_V70del_Y144del_N501 Y_A570D_D614G_P681H_T716I_S982A_D1118H)
  source 1..4085: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccaccggagagccagaagcgtggccagccagagcatcattgcctacacaatgtctctgggcgccgagaacagcgtggcctactccaacaactctatcgctatccccatcaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23620 - RNA, 4094 nt, synthetic construct
  misc_feature 1..4094: note = SARS-CoV-2/Wuhan/WIV05/2019__EPI_ISL_402128 spike protein mRNA gc mod (1-1273)(K986P_V987P_K986P_V987P_K417N_E484K_N501Y_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23621 - RNA, 4085 nt, synthetic construct
  misc_feature 1..4085: note = SARS-CoV-2/Wuhan/WIV05/2019__EPI_ISL_402128 spike protein mRNA gc mod (1-1273)(K986P_V987P_K986P_V987P_L18F_D80A_D215G_L242del_A2 43del_L244del_R246I_K417N_E484K_N501Y_D614G_A701V)
  source 1..4085: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacttcaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgtggagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23622 - RNA, 4094 nt, synthetic construct
  misc_feature 1..4094: note = SARS-CoV-2/Wuhan/WIV05/2019__EPI_ISL_402128 spike protein mRNA gc mod (1-1273)(K986P_V987P_K986P_V987P_E484K_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23623 - RNA, 4094 nt, synthetic construct
  misc_feature 1..4094: note = SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S _K417T_E484K_N501Y_D614G_H655Y_T1027I)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacttcaccaacagaacacagctgcctagcgcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23624 - RNA, 4094 nt, synthetic construct
  misc_feature 1..4094: note = SARS-CoV-2/Wuhan/WIV05/2019__EPI_ISL_402128 spike protein mRNA gc mod (1-1273)(K986P_V987P_K986P_V987P_S13I_W152C_L452R_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccatccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23625 - RNA, 1521 nt, synthetic construct
  misc_feature 1..1521: note = SARS-CoV-2/Wuhan/WIV05/2019__EPI_ISL_402128 spike protein mRNA gc (1-15,334-528) Ferritin construct
  source 1..1521: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcgggggtggaagcggcgggggtggaagtgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23626 - RNA, 1119 nt, synthetic construct
  misc_feature 1..1119: note = SARS-CoV-2/Wuhan/WIV05/2019__EPI_ISL_402128 spike protein mRNA gc (334-528) Foldon construct
  source 1..1119: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgcccatgggcagcctgcagccgctcgccaccctgtacctgctcgggatgctggtggcctccgtcctggcgaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcagcggcgggtacatccccgaggccccgcgcgacggccaggcctacgtgcggaaggacggcgagtgggtcctgctgagcaccttcctctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23627 - RNA, 1497 nt, synthetic construct
  misc_feature 1..1497: note = SARS-CoV-2/Wuhan/WIV05/2019__EPI_ISL_402128 spike protein mRNA gc (1-15,334-528) LumSynth construct
  source 1..1497: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcggcggcggctccggaggcggaggtagcgggggacagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23628 - RNA, 1458 nt, synthetic construct
  misc_feature 1..1458: note = SARS-CoV-2/Wuhan/WIV05/2019__EPI_ISL_402128 spike protein mRNA gc (334-528) LumSynth construct
  source 1..1458: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgcggcgggggcgggagcggcgggggcggctccgggggcgggaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23629 - RNA, 4191 nt, synthetic construct
  misc_feature 1..4191: note = SARS-CoV-2/Wuhan/WIV05/2019__EPI_ISL_402128 spike protein mRNA gc (1-1273)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23630 - RNA, 4191 nt, synthetic construct
  misc_feature 1..4191: note = SARS-CoV-2/Wuhan/WIV05/2019__EPI_ISL_402128 spike protein mRNA gc (1-1273)(D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23631 - RNA, 4191 nt, synthetic construct
  misc_feature 1..4191: note = SARS-CoV-2/Wuhan/WIV05/2019__EPI_ISL_402128 spike protein mRNA gc (1-1273)(A222V_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23632 - RNA, 4191 nt, synthetic construct
  misc_feature 1..4191: note = SARS-CoV-2/Wuhan/WIV05/2019__EPI_ISL_402128 spike protein mRNA gc (1-1273)(N439K_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23633 - RNA, 4191 nt, synthetic construct
  misc_feature 1..4191: note = SARS-CoV-2/Wuhan/WIV05/2019__EPI_ISL_402128 spike protein mRNA gc (1-1273)(S477N_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23634 - RNA, 4191 nt, synthetic construct
  misc_feature 1..4191: note = SARS-CoV-2/Wuhan/WIV05/2019__EPI_ISL_402128 spike protein mRNA gc (1-1273)(N501Y_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23635 - RNA, 4185 nt, synthetic construct
  misc_feature 1..4185: note = SARS-CoV-2/Wuhan/WIV05/2019__EPI_ISL_402128 spike protein mRNA gc (1-1273)(H69del_V70del_D614G)
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23636 - RNA, 4191 nt, synthetic construct
  misc_feature 1..4191: note = SARS-CoV-2/Wuhan/WIV05/2019__EPI_ISL_402128 spike protein mRNA gc (1-1273)(Y453F_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23637 - RNA, 4191 nt, synthetic construct
  misc_feature 1..4191: note = SARS-CoV-2/Wuhan/WIV05/2019__EPI_ISL_402128 spike protein mRNA gc (1-1273)(D614G_I692V)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23638 - RNA, 4191 nt, synthetic construct
  misc_feature 1..4191: note = SARS-CoV-2/Wuhan/WIV05/2019__EPI_ISL_402128 spike protein mRNA gc (1-1273)(D614G_M1229I)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23639 - RNA, 4185 nt, synthetic construct
  misc_feature 1..4185: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23640 - RNA, 4185 nt, synthetic construct
  misc_feature 1..4185: note = SARS-CoV-2/Wuhan/WIV05/2019__EPI_ISL_402128 spike protein mRNA gc (1-1273)(H69del_V70del_Y453F_D614G_I692V_M1229I)
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtgatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23641 - RNA, 4182 nt, synthetic construct
  misc_feature 1..4182: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4182: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgacgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactcccaccggcgcgcccggagcgtggcgtcccagagcatcatcgcctacaccatgtccctgggcgccgagaacagcgtcgcctactccaacaacagcatcgccatccccatcaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctcgcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccacccacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23642 - RNA, 4191 nt, synthetic construct
  misc_feature 1..4191: note = SARS-CoV-2/Wuhan/WIV05/2019__EPI_ISL_402128 spike protein mRNA gc (1-1273)(K417N_E484K_N501Y_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23643 - RNA, 4182 nt, synthetic construct
  misc_feature 1..4182: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4182: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacttcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgccaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccggggcctgccccaggggttcagcgccctcgagcccctggtggacctgcccatcggcatcaacatcacccgcttccagaccctccacatctcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgtggagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23644 - RNA, 4191 nt, synthetic construct
  misc_feature 1..4191: note = SARS-CoV-2/Wuhan/WIV05/2019__EPI_ISL_402128 spike protein mRNA gc (1-1273)(E484K_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23645 - RNA, 4191 nt, synthetic construct
  misc_feature 1..4191: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacttcaccaaccgcacgcagctgccgagcgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaactaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctcagcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaccatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgatcaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23646 - RNA, 4191 nt, synthetic construct
  misc_feature 1..4191: note = SARS-CoV-2/Wuhan/WIV05/2019__EPI_ISL_402128 spike protein mRNA gc (1-1273)(S13I_W152C_L452R_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagcatccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctgcatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactaccgctaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23647 - RNA, 4191 nt, synthetic construct; identical to SEQ ID NO: 23629
  misc_feature 1..4191: note = SARS-CoV-2/Wuhan/WIV05/2019__EPI_ISL_402128 spike protein mRNA gc (1-1273)
  source 1..4191: mol_type = other RNA

SEQ ID NO: 23648 - RNA, 4191 nt, synthetic construct
  misc_feature 1..4191: note = SARS-CoV-2/Wuhan/WIV05/2019__EPI_ISL_402128 spike protein mRNA gc (1-1273)(D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23649 - RNA, 4191 nt, synthetic construct
  misc_feature 1..4191: note = SARS-CoV-2/Wuhan/WIV05/2019__EPI_ISL_402128 spike protein mRNA gc (1-1273)(A222V_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtgctcgagcccctggtggacctgcccatcggcatcaacatcacccgcttccagaccctcctggccctgcaccggtcctacctcacgccgggggacagcagctccggctggaccgccggcgcggccgcctactacgtcgggtacctgcagccccgcaccttcctgctcaagtacaacgagaacggcaccatcacggacgccgtggactgcgcgctggaccccctgagcgagaccaagtgcaccctcaagtccttcaccgtggagaaggggatctaccagacgagcaacttccgggtccagcccaccgagtccatcgtgcgcttcccgaacatcaccaacctgtgccccttcggcgaggtcttcaacgccacccggttcgccagcgtgtacgcctggaaccgcaagcggatctccaactgcgtggccgactacagcgtcctgtacaactccgcgagcttctccacgttcaagtgctacggcgtgagccccaccaagctcaacgacctgtgcttcaccaacgtgtacgccgactccttcgtcatccgcggggacgaggtgcggcagatcgcccccggccagaccgggaagatcgccgactacaactacaagctgccggacgacttcacgggctgcgtgatcgcctggaacagcaacaacctcgactccaaggtcgggggcaactacaactacctgtaccgcctgttccgcaagagcaacctcaagcccttcgagcgggacatctccaccgagatctaccaggcgggcagcaccccctgcaacggggtggagggcttcaactgctacttccccctgcagtcctacgggttccagccgaccaacggcgtggggtaccagccctaccgggtcgtggtgctgagcttcgagctcctgcacgcccccgccacggtctgcggccccaagaagtccaccaacctggtgaagaacaagtgcgtgaacttcaacttcaacggcctcaccgggaccggcgtcctgaccgagagcaacaagaagttcctgccgttccagcagttcgggcgcgacatcgccgacacgaccgacgccgtgcgcgacccccagaccctggagatcctcgacatcaccccctgcagcttcggcggggtgtccgtcatcacgccgggcaccaacaccagcaaccaggtggcggtgctgtaccagggcgtcaactgcaccgaggtgcccgtggccatccacgccgaccagctgacgcccacctggcgggtctactccaccgggagcaacgtgttccagacccgcgccggctgcctcatcggggccgagcacgtgaacaactcctacgagtgcgacatccccatcggcgcgggcatctgcgccagctaccagacgcagaccaactccccgcggcgcgcccggagcgtcgcctcccagagcatcatcgcgtacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgccctgacgggcatcgcggtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggccgcggagatccgcgccagcgccaacctcgccgccaccaagatgtccgagtgcgtgctgggccagagcaagcgggtggacttctgcgggaagggctaccacctgatgtccttcccccagagcgcgccgcacggggtcgtgttcctccacgtcacgtacgtgcccgcccaggagaagaacttcaccaccgcccccgccatctgccacgacggcaaggcgcacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgccatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23650 - RNA, 4191 nt, synthetic construct
  misc_feature 1..4191: note = SARS-CoV-2/Wuhan/WIV05/2019__EPI_ISL_402128 spike protein mRNA gc (1-1273)(N439K_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23651 - RNA, 4191 nt, synthetic construct
  misc_feature 1..4191: note = SARS-CoV-2/Wuhan/WIV05/2019__EPI_ISL_402128 spike protein mRNA gc (1-1273)(S477N_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgagcgtgatcacgccgggcaccaacacctccaaccaggtcgccgtgctgtaccagggcgtgaactgcaccgaggtccccgtggccatccacgccgaccagctgacgcccacctggcgggtgtacagcaccgggtccaacgtcttccagacccgcgccggctgcctcatcggggcggagcacgtgaacaacagctacgagtgcgacatccccatcggcgccggcatctgcgcctcctaccagacgcagaccaacagcccgcggcgcgcccggtccgtggcgagccagtccatcatcgcctacaccatgagcctgggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctcctgctgcagtacgggagcttctgcacccagctcaaccgcgcgctgacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacacctccgccctcctggcgggcaccatcacgagcgggtggaccttcggcgccggcgccgccctgcagatccccttcgcgatgcagatggcctaccggttcaacgggatcggcgtcacccagaacgtgctctacgagaaccagaagctgatcgccaaccagttcaactccgccatcgggaagatccaggacagcctgtccagcaccgcctccgcgctcggcaagctgcaggacgtggtcaaccagaacgcccaggccctgaacacgctcgtgaagcagctgagctccaacttcggggccatcagctccgtgctgaacgacatcctcagccgcctggacaaggtcgaggccgaggtgcagatcgaccggctgatcaccggccgcctccagtccctgcagacctacgtgacccagcagctgatccgggcggccgagatccgcgccagcgccaacctcgccgcgaccaagatgagcgagtgcgtcctgggccagtccaagcgggtggacttctgcgggaagggctaccacctgatgagcttcccccagtccgccccgcacggggtggtcttcctccacgtgacgtacgtccccgcccaggagaagaacttcaccaccgcccccgcgatctgccacgacggcaaggcccacttcccccgcgagggggtgttcgtgagcaacggcacccactggttcgtcacgcagcggaacttctacgagccgcagatcatcaccaccgacaacaccttcgtgtccggcaactgcgacgtggtcatcgggatcgtgaacaacacggtgtacgaccccctgcagcccgagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccgtggtacatctggctgggcttcatcgccgggctgatcgcgatcgtgatggtgaccatcatgctctgctgcatgacctcctgctgcagctgcctgaagggctgctgctcctgcgggagctgctgcaagttcgacgaggacgactccgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23652 - RNA, 4191 nt, synthetic construct
  misc_feature 1..4191: note = SARS-CoV-2/Wuhan/WIV05/2019__EPI_ISL_402128 spike protein mRNA gc (1-1273)(N501Y_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23653 - RNA, 4185 nt, synthetic construct
  misc_feature 1..4185: note = SARS-CoV-2/Wuhan/WIV05/2019__EPI_ISL_402128 spike protein mRNA gc (1-1273)(H69del_V70del_D614G)
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtggcctactccaacaacagcatcgccatccccaccaacttcacgatctccgtcaccaccgagatcctgcccgtgagcatgaccaagacgagcgtggactgcaccatgtacatctgcggcgactccaccgagtgcagcaacctcctgctgcagtacgggtccttctgcacccagctcaaccgcgcgctgacgggcatcgccgtcgagcaggacaagaacacccaggaggtgttcgcccaggtgaagcagatctacaagacgcccccgatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtcctctacgagaaccagaagctgatcgccaaccagttcaacagcgccatcgggaagatccaggactccctgagctccaccgccagcgcgctcggcaagctgcaggacgtggtgaaccagaacgcccaggccctgaacacgctcgtcaagcagctgtccagcaacttcggggccatctccagcgtgctgaacgacatcctctcccgcctggacaaggtggaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgccccgcacggggtggtgttcctccacgtcacgtacgtgcccgcccaggagaagaacttcaccaccgcccccgcgatctgccacgacggcaaggcccacttcccccgcgagggggtcttcgtgtccaacggcacccactggttcgtgacgcagcggaacttctacgagccgcagatcatcaccaccgacaacaccttcgtcagcggcaactgcgacgtggtgatcgggatcgtcaacaacacggtgtacgaccccctgcagcccgagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagcccgtgctgaagggcgtcaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23654 - RNA, 4191 nt, synthetic construct
  misc_feature 1..4191: note = SARS-CoV-2/Wuhan/WIV05/2019__EPI_ISL_402128 spike protein mRNA gc (1-1273)(Y453F_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23655 - RNA, 4191 nt, synthetic construct
  misc_feature 1..4191: note = SARS-CoV-2/Wuhan/WIV05/2019__EPI_ISL_402128 spike protein mRNA gc (1-1273)(D614G_I692V)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcgtcatcgcctacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgcgctgacgggcatcgccgtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtcctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtgctctacgagaaccagaagctgatcgccaaccagttcaacagcgccatcgggaagatccaggactccctgagctccaccgccagcgcgctcggcaagctgcaggacgtcgtgaaccagaacgcccaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggcggccgagatccgcgccagcgccaacctcgccgcgaccaagatgtccgagtgcgtgctgggccagagcaagcgggtggacttctgcgggaagggctaccacctgatgtccttcccccagagcgccccgcacggggtcgtgttcctccacgtcacgtacgtgcccgcccaggagaagaacttcaccaccgcccccgcgatctgccacgacggcaaggcccacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgcgatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23656 - RNA, 4191 nt, synthetic construct
  misc_feature 1..4191: note = SARS-CoV-2/Wuhan/WIV05/2019__EPI_ISL_402128 spike protein mRNA gc (1-1273)(D614G_M1229I)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatcgtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23657 - RNA, 4185 nt, synthetic construct
  misc_feature 1..4185: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgtcctcgagcccctggtggacctgcccatcggcatcaacatcacccgcttccagaccctcctggccctgcaccggtcctacctcacgccgggggacagcagctccggctggaccgccggcgcggccgcctactacgtggggtacctgcagccccgcaccttcctgctcaagtacaacgagaacggcaccatcacggacgccgtcgactgcgcgctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggccgactacagcgtgctgtacaactccgcgagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcctggaacagcaacaacctcgactccaaggtcgggggcaactacaactacctgttccgcctgttccgcaagagcaacctcaagcccttcgagcgggacatctccaccgagatctaccaggcgggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgccgtccgcgacccccagaccctggagatcctcgacatcaccccctgcagcttcggcggggtgagcgtgatcacgccgggcaccaacacctccaaccaggtcgcggtgctgtaccagggcgtgaactgcaccgaggtccccgtggccatccacgccgaccagctgacgcccacctggcgggtgtacagcaccgggtccaacgtcttccagacccgcgccggctgcctcatcggggccgagcacgtgaacaacagctacgagtgcgacatccccatcggcgcgggcatctgcgcctcctaccagacgcagaccaacagcccgcggcgcgcccggtccgtggccagccagtccgtcatcgcgtacaccatgagcctgggggccgagaactccgtggcctacagcaacaactccatcgccatccccaccaacttcacgatcagcgtgaccaccgagatcctgcccgtctccatgaccaagacgagcgtggactgcaccatgtacatctgcggcgacagcaccgagtgctccaacctcctgctgcagtacgggagcttctgcacccagctcaaccgcgccctgacgggcatcgcggtggagcaggacaagaacacccaggaggtcttcgcccaggtgaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacacctccgccctcctggccggcaccatcacgagcgggtggaccttcggcgcgggcgccgccctgcagatccccttcgccatgcagatggcgtaccggttcaacgggatcggcgtgacccagaacgtgctctacgagaaccagaagctgatcgccaaccagttcaactccgccatcgggaagatccaggacagcctgtccagcaccgcctccgccctcggcaagctgcaggacgtcgtgaaccagaacgcgcaggccctgaacacgctcgtgaagcagctgagctccaacttcggggccatcagctccgtcctgaacgacatcctcagccgcctggacaaggtggaggccgaggtgcagatcgaccggctgatcaccggccgcctccagtccctgcagacctacgtcacccagcagctgatccgggccgcggagatccgcgccagcgccaacctcgccgccaccaagatgagcgagtgcgtgctgggccagtccaagcgggtggacttctgcgggaagggctaccacctgatgagcttcccccagtccgcgccgcacggggtcgtgttcctccacgtcacgtacgtgcccgcccaggagaagaacttcaccaccgcccccgccatctgccacgacggcaaggcgcacttcccccgcgagggggtgttcgtcagcaacggcacccactggttcgtgacgcagcggaacttctacgagccgcagatcatcaccaccgacaacaccttcgtgtccggcaactgcgacgtcgtgatcgggatcgtgaacaacacggtctacgaccccctgcagcccgagctggacagcttcaaggaggagctcgacaagtacttcaagaaccacacctcccccgacgtggacctgggcgacatcagcgggatcaacgcctccgtggtcaacatccagaaggagatcgaccgcctgaacgaggtggccaagaacctcaacgagagcctgatcgacctgcaggagctcggcaagtacgagcagtacatcaagtggccgtggtacatctggctgggcttcatcgccgggctgatcgccatcgtgatggtcaccatcatgctctgctgcatgacctcctgctgcagctgcctgaagggctgctgctcctgcgggagctgctgcaagttcgacgaggacgactccgagcccgtgctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23658 - RNA, 4185 nt, synthetic construct
  misc_feature 1..4185: note = SARS-CoV-2/Wuhan/WIV05/2019__EPI_ISL_402128 spike protein mRNA gc (1-1273)(H69del_V70del_Y453F_D614G_I692V_M1229I)
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcgtgatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatcgtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23659 - RNA, 4182 nt, synthetic construct
  misc_feature 1..4182: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4182: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgacgacacgaccgacgccgtgcgcgacccccagaccctggagatcctcgacatcaccccctgcagcttcggcggggtctccgtgatcacgccgggcaccaacaccagcaaccaggtggcggtcctgtaccagggcgtgaactgcaccgaggtgcccgtcgccatccacgccgaccagctgacgcccacctggcgggtgtactccaccgggagcaacgtgttccagacccgcgccggctgcctcatcggggccgagcacgtcaacaactcctacgagtgcgacatccccatcggcgcgggcatctgcgccagctaccagacgcagaccaactcccaccggcgcgcccggagcgtggcctcccagagcatcatcgcgtacaccatgtccctgggggccgagaacagcgtggcctactccaacaacagcatcgccatcccgatcaacttcaccatctccgtcacgaccgagatcctgcccgtgagcatgaccaagaccagcgtggactgcacgatgtacatctgcggcgactccaccgagtgcagcaacctcctgctgcagtacgggtccttctgcacccagctcaaccgcgccctgaccggcatcgcggtcgagcaggacaagaacacgcaggaggtgttcgcccaggtgaagcagatctacaagaccccgcccatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgccgcgcgcgacctgatctgcgcccagaagttcaacgggctgaccgtgctgcccccgctcctgacggacgagatgatcgcccagtacaccagcgccctcctggccggcaccatcacctccgggtggacgttcggcgcgggcgccgccctgcagatccccttcgccatgcagatggcgtaccggttcaacgggatcggcgtgacccagaacgtcctctacgagaaccagaagctgatcgccaaccagttcaacagcgccatcgggaagatccaggactccctgagctccaccgccagcgccctcggcaagctgcaggacgtggtgaaccagaacgcgcaggccctgaacaccctcgtcaagcagctgtccagcaacttcggggccatctccagcgtgctgaacgacatcctcgcccgcctggacaaggtggaggccgaggtccagatcgaccggctgatcacgggccgcctccagtccctgcagacctacgtgacccagcagctgatccgggcggccgagatccgcgccagcgccaacctcgccgcgaccaagatgagcgagtgcgtgctgggccagtccaagcgggtcgacttctgcgggaagggctaccacctgatgagcttcccccagtccgcgccccacggggtggtgttcctccacgtcacctacgtgccggcccaggagaagaacttcacgaccgcccccgccatctgccacgacggcaaggcccacttcccccgcgagggggtcttcgtgagcaacggcacccactggttcgtgacccagcggaacttctacgagccccagatcatcacgacccacaacaccttcgtctccggcaactgcgacgtggtgatcgggatcgtcaacaacaccgtgtacgacccgctgcagcccgagctggacagcttcaaggaggagctcgacaagtacttcaagaaccacacgtcccccgacgtggacctgggcgacatcagcgggatcaacgcctccgtcgtgaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtcatggtgaccatcatgctctgctgcatgacctcctgctgcagctgcctgaagggctgctgctcctgcgggagctgctgcaagttcgacgaggacgactccgagccggtgctgaagggcgtcaagctccactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23660 - RNA, 4191 nt, synthetic construct
  misc_feature 1..4191: note = SARS-CoV-2/Wuhan/WIV05/2019__EPI_ISL_402128 spike protein mRNA gc (1-1273)(K417N_E484K_N501Y_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23661 - RNA, 4182 nt, synthetic construct
  misc_feature 1..4182: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4182: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacttcaccacccgcacgcagctcccgcccgcctacaccaacagcttcacccggggcgtctactaccccgacaaggtgttccgctccagcgtgctgcactccacccaggacctgttcctccccttcttcagcaacgtcacgtggttccacgccatccacgtgtccgggaccaacggcaccaagcggttcgcgaacccggtgctgcccttcaacgacggggtctacttcgccagcaccgagaagtccaacatcatccgcggctggatcttcgggacgaccctggacagcaagacccagtccctcctgatcgtgaacaacgccaccaacgtggtcatcaaggtgtgcgagttccagttctgcaacgaccccttcctgggcgtgtactaccacaagaacaacaagagctggatggagtccgagttccgggtctacagctccgccaacaactgcacgttcgagtacgtgagccagcccttcctcatggacctggagggcaagcaggggaacttcaagaacctgcgcgagttcgtgttcaagaacatcgacggctacttcaagatctactccaagcacaccccgatcaacctcgtccgggggctgccccagggcttcagcgccctggagcccctcgtggacctgcccatcgggatcaacatcacccgcttccagaccctgcacatctcctacctcacgccgggcgacagcagctccggctggaccgcgggggccgccgcctactacgtgggctacctgcagccccggaccttcctgctcaagtacaacgagaacgggaccatcacggacgcggtcgactgcgccctggaccccctgagcgagaccaagtgcaccctcaagtccttcaccgtggagaagggcatctaccagacgagcaacttccgcgtgcagcccaccgagtccatcgtccggttcccgaacatcaccaacctgtgccccttcggcgaggtgttcaacgccacccgcttcgccagcgtctacgcctggaaccggaagcgcatctccaactgcgtggcggactacagcgtgctgtacaactccgccagcttctccacgttcaagtgctacggggtcagccccaccaagctcaacgacctgtgcttcaccaacgtgtacgccgactccttcgtgatccggggcgacgaggtccgccagatcgcccccgggcagaccggcaacatcgccgactacaactacaagctgccggacgacttcacggggtgcgtgatcgcgtggaacagcaacaacctcgactccaaggtgggcggcaactacaactacctgtaccggctgttccgcaagagcaacctcaagcccttcgagcgggacatctccaccgagatctaccaggccgggagcaccccctgcaacggcgtcaaggggttcaactgctacttccccctgcagtcctacggcttccagccgacctacggggtgggctaccagccctaccgcgtggtcgtgctgagcttcgagctcctgcacgcccccgccacggtgtgcggccccaagaagtccaccaacctggtcaagaacaagtgcgtgaacttcaacttcaacgggctcaccggcaccggggtgctgaccgagagcaacaagaagttcctgccgttccagcagttcggccgggacatcgccgacacgaccgacgcggtccgcgacccccagaccctcgagatcctggacatcaccccctgcagcttcgggggcgtgtccgtgatcacgccgggcaccaacaccagcaaccaggtcgccgtgctgtaccagggggtgaactgcaccgaggtccccgtggccatccacgccgaccagctgacgcccacctggcgcgtgtactccaccggcagcaacgtcttccagacccgggccgggtgcctcatcggcgcggagcacgtgaacaactcctacgagtgcgacatccccatcggcgccgggatctgcgccagctaccagacgcagaccaactccccgcgccgggcccgcagcgtggcgtcccagagcatcatcgcctacaccatgtccctgggcgtcgagaacagcgtggcctactccaacaacagcatcgccatccccaccaacttcacgatctccgtgaccaccgagatcctgcccgtcagcatgaccaagacgagcgtggactgcaccatgtacatctgcggggactccaccgagtgcagcaacctcctgctgcagtacggctccttctgcacccagctcaaccgggccctgacggggatcgcggtggagcaggacaagaacacccaggaggtcttcgcccaggtgaagcagatctacaagacgcccccgatcaaggacttcggcggcttcaacttcagccagatcctgcccgacccctccaagcccagcaagcgctccttcatcgaggacctcctgttcaacaaggtgaccctggccgacgccgggttcatcaagcagtacggcgactgcctcggggacatcgccgcgcgggacctgatctgcgcccagaagttcaacggcctgaccgtcctcccgcccctgctgaccgacgagatgatcgcccagtacaccagcgccctcctggccgggaccatcacgtccggctggaccttcggcgcgggggccgccctgcagatccccttcgccatgcagatggcgtaccgcttcaacggcatcggggtgacccagaacgtgctctacgagaaccagaagctgatcgccaaccagttcaacagcgccatcggcaagatccaggactccctgagctccaccgccagcgccctcgggaagctgcaggacgtcgtgaaccagaacgcgcaggccctgaacacgctcgtgaagcagctgtccagcaacttcggcgccatctccagcgtcctgaacgacatcctctcccggctggacaaggtggaggccgaggtgcagatcgaccgcctgatcaccggccggctccagagcctgcagacctacgtcacccagcagctgatccgcgccgcggagatccgggccagcgccaacctcgccgccaccaagatgtccgagtgcgtgctggggcagagcaagcgcgtggacttctgcggcaaggggtaccacctgatgtccttcccccagagcgcgccgcacggcgtcgtgttcctccacgtcacgtacgtgcccgcccaggagaagaacttcaccaccgcccccgccatctgccacgacgggaaggcgcacttcccccgggagggcgtgttcgtctccaacggcacccactggttcgtgacgcagcgcaacttctacgagccgcagatcatcaccaccgacaacaccttcgtgagcgggaactgcgacgtcgtgatcggcatcgtgaacaacacggtctacgaccccctgcagcccgagctggactccttcaaggaggagctcgacaagtacttcaagaaccacaccagccccgacgtggacctgggggacatctccggcatcaacgccagcgtggtcaacatccagaaggagatcgaccggctgaacgaggtggccaagaacctcaacgagtccctgatcgacctgcaggagctcggcaagtacgagcagtacatcaagtggccgtggtacatctggctggggttcatcgccggcctgatcgccatcgtgatggtcaccatcatgctctgctgcatgaccagctgctgctcctgcctgaaggggtgctgcagctgcggctcctgctgcaagttcgacgaggacgacagcgagcccgtgctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23662 - RNA, 4191 nt, synthetic construct
  misc_feature 1..4191: note = SARS-CoV-2/Wuhan/WIV05/2019__EPI_ISL_402128 spike protein mRNA gc (1-1273)(E484K_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23663 - RNA, 4191 nt, synthetic construct
  misc_feature 1..4191: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacttcaccaaccgcacccagctcccgagcgcctacacgaactccttcacccggggcgtctactaccccgacaaggtgttccgcagctccgtgctgcacagcacccaggacctgttcctccccttcttctccaacgtcacctggttccacgccatccacgtgagcgggacgaacggcaccaagcggttcgacaaccccgtgctgccgttcaacgacggggtctacttcgcgtccaccgagaagtccaacatcatccgcggctggatcttcgggaccacgctggactccaagacccagagcctcctgatcgtgaacaacgccaccaacgtggtcatcaaggtgtgcgagttccagttctgcaactaccccttcctgggcgtgtactaccacaagaacaacaagtcctggatggagagcgagttccgggtctactccagcgccaacaactgcaccttcgagtacgtgtcccagcccttcctcatggacctggagggcaagcaggggaacttcaagaacctgagcgagttcgtgttcaagaacatcgacggctacttcaagatctactccaagcacacgcccatcaacctcgtccgcgacctgccgcaggggttcagcgccctggagcccctcgtggacctgcccatcggcatcaacatcacccggttccagaccctgctcgccctgcaccgcagctacctgacccccggggactccagctccggctggacggcgggcgccgccgcctactacgtggggtacctccagccgcggaccttcctgctgaagtacaacgagaacggcaccatcaccgacgcggtcgactgcgccctcgaccccctgagcgagacgaagtgcaccctgaagtccttcaccgtggagaaggggatctaccagaccagcaacttccgcgtgcagcccacggagtccatcgtccggttccccaacatcaccaacctctgcccgttcggcgaggtgttcaacgccacccgcttcgccagcgtctacgcctggaaccggaagcgcatctccaactgcgtggcggactacagcgtgctgtacaactccgccagcttctccaccttcaagtgctacggcgtcagccccacgaagctgaacgacctctgcttcaccaacgtgtacgccgactccttcgtgatccgcggggacgaggtccggcagatcgcccccggccagaccgggaccatcgccgactacaactacaagctgcccgacgacttcacgggctgcgtgatcgcgtggaacagcaacaacctggactccaaggtcgggggcaactacaactacctctaccggctgttccgcaagagcaacctgaagccgttcgagcgggacatctccaccgagatctaccaggccggcagcaccccctgcaacggggtgaagggcttcaactgctacttccccctccagagctacgggttccagcccacctacggcgtggggtaccagccgtaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgcccttccagcagttcgggcgggacatcgccgacacgaccgacgcggtccgcgacccgcagaccctggagatcctggacatcaccccctgcagcttcggcggggtgtccgtgatcacgcccggcaccaacaccagcaaccaggtcgccgtgctctaccagggcgtgaactgcaccgaggtcccggtggccatccacgccgaccagctgacgcccacctggcgcgtgtactccaccgggagcaacgtcttccagacccgggccggctgcctgatcggggcggagtacgtgaacaactcctacgagtgcgacatccccatcggcgccggcatctgcgccagctaccagacgcagaccaacagcccccgccgggcccgcagcgtggcgtcccagagcatcatcgcctacaccatgtccctcggggccgagaacagcgtcgcctactccaacaacagcatcgccatcccgaccaacttcacgatcagcgtgaccaccgagatcctgcccgtgtccatgaccaagacgagcgtcgactgcaccatgtacatctgcggcgactccaccgagtgcagcaacctgctcctgcagtacgggtccttctgcacccagctgaaccgggcgctcacgggcatcgccgtggagcaggacaagaacacccaggaggtgttcgcccaggtcaagcagatctacaagaccccgcccatcaaggacttcgggggcttcaacttcagccagatcctgcccgacccctccaagcccagcaagcgctccttcatcgaggacctcctgttcaacaaggtgaccctggccgacgccggcttcatcaagcagtacggggactgcctgggcgacatcgcggcccgggacctcatctgcgcccagaagttcaacgggctgacggtgctgcccccgctcctgaccgacgagatgatcgcccagtacaccagcgccctgctcgcgggcaccatcacgtccgggtggaccttcggcgccggcgccgccctgcagatccccttcgcgatgcagatggcctaccgcttcaacgggatcggcgtcacccagaacgtgctgtacgagaaccagaagctcatcgccaaccagttcaacagcgccatcgggaagatccaggactccctgagctccaccgccagcgcgctgggcaagctccaggacgtggtcaaccagaacgcccaggccctgaacacgctggtgaagcagctctccagcaacttcggggccatctccagcgtgctgaacgacatcctgagccggctcgacaaggtcgaggccgaggtgcagatcgaccgcctgatcaccggccggctgcagtccctccagacctacgtgacccagcagctgatccgcgcggccgagatccgggccagcgccaacctggccgcgatcaagatgtccgagtgcgtcctcggccagagcaagcgcgtggacttctgcgggaagggctaccacctgatgtccttcccccagagcgcgccccacggggtggtcttcctgcacgtgacctacgtcccggcccaggagaagaacttcacgaccgcccccgccatctgccacgacggcaaggcccacttcccccgggagggggtgttcgtgtccaacggcacccactggttcgtcacccagcgcaacttctacgagccccagatcatcacgaccgacaacaccttcgtgagcggcaactgcgacgtggtcatcgggatcgtgaacaacaccgtgtacgacccgctccagcccgagctggactccttcaaggaggagctggacaagtacttcaagaaccacacgagccccgacgtcgacctcggcgacatctccgggatcaacgccagcgtggtgaacatccagaaggagatcgaccggctgaacgaggtcgccaagaacctgaacgagtccctcatcgacctgcaggagctgggcaagtacgagcagtacatcaagtggccctggtacatctggctcggcttcatcgccgggctgatcgcgatcgtgatggtgaccatcatgctgtgctgcatgaccagctgctgctcctgcctcaagggctgctgcagctgcgggtcctgctgcaagttcgacgaggacgacagcgagccggtcctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23664 - RNA, 4191 nt, synthetic construct
  misc_feature 1..4191: note = SARS-CoV-2/Wuhan/WIV05/2019__EPI_ISL_402128 spike protein mRNA gc (1-1273)(S13I_W152C_L452R_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagcatccagtgcgtgaacctcaccacccgcacgcagctgccgcccgcctacaccaactccttcacccggggcgtctactaccccgacaaggtgttccgcagctccgtgctgcacagcacccaggacctcttcctgcccttcttctccaacgtcacgtggttccacgccatccacgtgagcgggaccaacggcaccaagcggttcgacaacccggtgctgcccttcaacgacggggtctacttcgcgtccaccgagaagtccaacatcatccgcggctggatcttcgggacgaccctcgacagcaagacccagagcctgctgatcgtgaacaacgccaccaacgtggtcatcaaggtgtgcgagttccagttctgcaacgaccccttcctcggcgtgtactaccacaagaacaacaagtcctgcatggagagcgagttccgggtctactccagcgccaacaactgcacgttcgagtacgtgtcccagcccttcctgatggacctggagggcaagcaggggaacttcaagaacctccgcgagttcgtgttcaagaacatcgacggctacttcaagatctacagcaagcacaccccgatcaacctggtccgggacctgccccaggggttctccgccctcgagcccctggtggacctgcccatcggcatcaacatcacccgcttccagaccctcctggccctgcaccggagctacctcacgccgggggactccagcagcggctggaccgcgggcgccgccgcctactacgtggggtacctgcagccccgcaccttcctgctcaagtacaacgagaacggcaccatcacggacgcggtcgactgcgccctggaccccctgtccgagaccaagtgcaccctcaagagcttcaccgtggagaaggggatctaccagacgtccaacttccgggtgcagcccaccgagagcatcgtccgcttcccgaacatcaccaacctgtgccccttcggcgaggtgttcaacgccacccggttcgcctccgtctacgcctggaaccgcaagcggatcagcaactgcgtggcggactactccgtgctgtacaacagcgcctccttcagcacgttcaagtgctacggcgtctcccccaccaagctcaacgacctgtgcttcaccaacgtgtacgccgacagcttcgtgatccgcggggacgaggtccggcagatcgcccccggccagaccgggaagatcgccgactacaactacaagctgccggacgacttcacgggctgcgtgatcgcgtggaactccaacaacctcgacagcaaggtcgggggcaactacaactaccgctaccggctgttccgcaagtccaacctgaagcccttcgagcgggacatcagcaccgagatctaccaggccggctccaccccctgcaacggggtggagggcttcaactgctacttccccctccagagctacgggttccagccgaccaacggcgtggggtaccagccctaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgccgttccagcagttcgggcgcgacatcgccgacacgaccgacgcggtccgggacccccagaccctggagatcctggacatcaccccctgcagcttcggcggggtgagcgtgatcacgccgggcaccaacacctccaaccaggtcgccgtgctctaccagggcgtgaactgcaccgaggtccccgtggccatccacgccgaccagctgacgcccacctggcgcgtgtacagcaccgggtccaacgtcttccagacccgggccggctgcctgatcggggcggagcacgtgaacaacagctacgagtgcgacatccccatcggcgccggcatctgcgcctcctaccagacgcagaccaacagcccgcgccgggcccgctccgtggcgagccagtccatcatcgcctacaccatgagcctcggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctgctcctgcagtacgggagcttctgcacccagctgaaccgggcgctcacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcgcagcttcatcgaggacctcctgttcaacaaggtgaccctggccgacgccggcttcatcaagcagtacggggactgcctgggcgacatcgcggcccgggacctcatctgcgcccagaagttcaacgggctgaccgtgctgccgcccctcctgaccgacgagatgatcgcccagtacacctccgccctgctcgcgggcaccatcacgagcgggtggaccttcggcgccggcgccgccctgcagatccccttcgcgatgcagatggcctaccgcttcaacgggatcggcgtcacccagaacgtgctgtacgagaaccagaagctcatcgccaaccagttcaactccgccatcgggaagatccaggacagcctgtccagcaccgcctccgcgctgggcaagctccaggacgtggtcaaccagaacgcccaggccctgaacacgctggtgaagcagctcagctccaacttcggggccatcagctccgtgctgaacgacatcctgagccggctcgacaaggtcgaggccgaggtgcagatcgaccgcctgatcaccggccggctgcagtccctccagacctacgtgacccagcagctgatccgcgcggccgagatccgggccagcgccaacctggccgcgaccaagatgagcgagtgcgtcctcggccagtccaagcgcgtggacttctgcgggaagggctaccacctgatgagcttcccccagtccgccccgcacggggtggtcttcctgcacgtgacgtacgtccccgcccaggagaagaacttcaccaccgcccccgcgatctgccacgacggcaaggcccacttcccccgggagggggtgttcgtgagcaacggcacccactggttcgtcacgcagcgcaacttctacgagccgcagatcatcaccaccgacaacaccttcgtgtccggcaactgcgacgtggtcatcgggatcgtgaacaacacggtgtacgaccccctccagcccgagctggacagcttcaaggaggagctggacaagtacttcaagaaccacacctcccccgacgtcgacctcggcgacatcagcgggatcaacgcctccgtggtgaacatccagaaggagatcgaccggctgaacgaggtcgccaagaacctgaacgagagcctcatcgacctgcaggagctgggcaagtacgagcagtacatcaagtggccgtggtacatctggctcggcttcatcgccgggctgatcgcgatcgtgatggtgaccatcatgctgtgctgcatgacctcctgctgcagctgcctcaagggctgctgctcctgcgggagctgctgcaagttcgacgaggacgactccgagcccgtcctgaagggcgtgaagctgcactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23665 - RNA, 4191 nt, synthetic construct
  misc_feature 1..4191: note = SARS-CoV-2/Wuhan/WIV05/2019__EPI_ISL_402128 spike protein mRNA gc (1-1273)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccaggacgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23666 - RNA, 4191 nt, synthetic construct
  misc_feature 1..4191: note = SARS-CoV-2/Wuhan/WIV05/2019__EPI_ISL_402128 spike protein mRNA gc (1-1273)(D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23667 - RNA, 4191 nt, synthetic construct
  misc_feature 1..4191: note = SARS-CoV-2/Wuhan/WIV05/2019__EPI_ISL_402128 spike protein mRNA gc (1-1273)(A222V_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23668 - RNA, 4191 nt, synthetic construct
  misc_feature 1..4191: note = SARS-CoV-2/Wuhan/WIV05/2019__EPI_ISL_402128 spike protein mRNA gc (1-1273)(N439K_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaagaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23669 - RNA, 4191 nt, synthetic construct
  misc_feature 1..4191: note = SARS-CoV-2/Wuhan/WIV05/2019__EPI_ISL_402128 spike protein mRNA gc (1-1273)(S477N_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23670 - RNA, 4191 nt, synthetic construct
  misc_feature 1..4191: note = SARS-CoV-2/Wuhan/WIV05/2019__EPI_ISL_402128 spike protein mRNA gc (1-1273)(N501Y_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23671 - RNA, 4185 nt, synthetic construct
  misc_feature 1..4185: note = SARS-CoV-2/Wuhan/WIV05/2019__EPI_ISL_402128 spike protein mRNA gc (1-1273)(H69del_V70del_D614G)
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23672 - RNA, 4191 nt, synthetic construct
  misc_feature 1..4191: note = SARS-CoV-2/Wuhan/WIV05/2019__EPI_ISL_402128 spike protein mRNA gc (1-1273)(Y453F_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23673 - RNA, 4191 nt, synthetic construct
  misc_feature 1..4191: note = SARS-CoV-2/Wuhan/WIV05/2019__EPI_ISL_402128 spike protein mRNA gc (1-1273)(D614G_I692V)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23674 - RNA, 4191 nt, synthetic construct
  misc_feature 1..4191: note = SARS-CoV-2/Wuhan/WIV05/2019__EPI_ISL_402128 spike protein mRNA gc (1-1273)(D614G_M1229I)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23675 - RNA, 4185 nt, synthetic construct
  misc_feature 1..4185: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23676 - RNA, 4185 nt, synthetic construct
  misc_feature 1..4185: note = SARS-CoV-2/Wuhan/WIV05/2019__EPI_ISL_402128 spike protein mRNA gc (1-1273)(H69del_V70del_Y453F_D614G_I692V_M1229I)
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23677 - RNA, 4182 nt, synthetic construct
  misc_feature 1..4182: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4182: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgacgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcacaccggagggcaaggagcgtggccagccagagcatcatcgcctacaccatgagcctgggcgccgagaacagcgtggcctacagcaacaacagcatcgccatccccatcaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctggcccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23678 - RNA, 4191 nt, synthetic construct
  misc_feature 1..4191: note = SARS-CoV-2/Wuhan/WIV05/2019__EPI_ISL_402128 spike protein mRNA gc (1-1273)(K417N_E484K_N501Y_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23679 - RNA, 4182 nt, synthetic construct
  misc_feature 1..4182: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4182: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacttcaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgccaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcggggcctgccccagggcttctcagccctggagcccctggtggacctgcccatcggcatcaacatcacccggttccagaccctgcacatcagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgtggagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23680 - RNA, 4191 nt, synthetic construct
  misc_feature 1..4191: note = SARS-CoV-2/Wuhan/WIV05/2019__EPI_ISL_402128 spike protein mRNA gc (1-1273)(E484K_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23681 - RNA, 4191 nt, synthetic construct
  misc_feature 1..4191: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacttcaccaaccggacccagctgccaagcgcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaactaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgagcgagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaccatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagtacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccatcaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23682 - RNA, 4191 nt, synthetic construct
  misc_feature 1..4191: note = SARS-CoV-2/Wuhan/WIV05/2019__EPI_ISL_402128 spike protein mRNA gc (1-1273)(S13I_W152C_L452R_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcatccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctgcatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactaccgctaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23683 - RNA, 4191 nt, synthetic construct
  misc_feature 1..4191: note = SARS-CoV-2/Wuhan/WIV05/2019__EPI_ISL_402128 spike protein mRNA gc (1-1273)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccaggacgtgaactgcaccgaggtgcccgtggccatccacgccgaccagctgacccccacctggcgggtgtacagcaccggaagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgattgcctgggcgacatcgccgctcgggacctgatctgcgcccagaagttcaacgggctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggcgtgttcgtgagcaacggaacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgatgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23684 - RNA, 4191 nt, synthetic construct
  misc_feature 1..4191: note = SARS-CoV-2/Wuhan/WIV05/2019__EPI_ISL_402128 spike protein mRNA gc (1-1273)(D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23685 - RNA, 4191 nt, synthetic construct
  misc_feature 1..4191: note = SARS-CoV-2/Wuhan/WIV05/2019__EPI_ISL_402128 spike protein mRNA gc (1-1273)(A222V_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtcagcgtgatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagcccccggcgggcccggagcgtggccagccagagcatcatcgcctacaccatgagcttaggcgccgagaacagcgtggcctacagcaacaacagcatcgccatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttttgcggcaagggctaccacctgatgagcttcccccagagcgccccacacggcgtggtcttcctccacgtgacatacgtgcccgcccaggagaagaacttcaccaccgcccccgccatttgccacgacggcaaggcccacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgctagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23686 - RNA, 4191 nt, synthetic construct
  misc_feature 1..4191: note = SARS-CoV-2/Wuhan/WIV05/2019__EPI_ISL_402128 spike protein mRNA gc (1-1273)(N439K_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaagaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggacaaggtggaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23687 - RNA, 4191 nt, synthetic construct
  misc_feature 1..4191: note = SARS-CoV-2/Wuhan/WIV05/2019__EPI_ISL_402128 spike protein mRNA gc (1-1273)(S477N_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcaacaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgcgcctcctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaatttcggcgccatcagcagcgtgctgaacgacatcctgtcaaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23688 - RNA, 4191 nt, synthetic construct
  misc_feature 1..4191: note = SARS-CoV-2/Wuhan/WIV05/2019__EPI_ISL_402128 spike protein mRNA gc (1-1273)(N501Y_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggacaaggtggaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23689 - RNA, 4185 nt, synthetic construct
  misc_feature 1..4185: note = SARS-CoV-2/Wuhan/WIV05/2019__EPI_ISL_402128 spike protein mRNA gc (1-1273)(H69del_V70del_D614G)
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtgacatacgtccccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23690 - RNA, 4191 nt, synthetic construct
  misc_feature 1..4191: note = SARS-CoV-2/Wuhan/WIV05/2019__EPI_ISL_402128 spike protein mRNA gc (1-1273)(Y453F_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23691 - RNA, 4191 nt, synthetic construct
  misc_feature 1..4191: note = SARS-CoV-2/Wuhan/WIV05/2019__EPI_ISL_402128 spike protein mRNA gc (1-1273)(D614G_I692V)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtcttcctccacgtgacatacgtgcccgcccaggagaagaacttcaccaccgcccccgccatctgccacgacggcaaggctcacttcccccgggagggagtgttcgtgagcaacggcacccactggttcgtgacccagcggaacttctacgagccccagattatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23692 - RNA, 4191 nt, synthetic construct
  misc_feature 1..4191: note = SARS-CoV-2/Wuhan/WIV05/2019__EPI_ISL_402128 spike protein mRNA gc (1-1273)(D614G_M1229I)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23693 - RNA, 4185 nt, synthetic construct
  misc_feature 1..4185: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcaacaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtgagcgtcatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgccggcatctgcgcttcctaccagacccagaccaacagcccccggcgggcccggagcgtggccagccagagcgtgatcgcctacaccatgagcttaggcgccgagaacagcgtggcctacagcaacaacagcatcgccatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaattttggcgccatcagcagcgtgctgaacgacatcctgtcaaggctggacaaggtggaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttctgcggcaagggctaccacctgatgagcttcccccagagcgccccacacggcgtggtcttcctccacgtgacatacgtgcccgcccaggagaagaacttcaccaccgcccccgccatctgccacgacggcaaggcccacttcccccgggagggagtgttcgtgagcaacggcacccactggttcgtgacccagcggaacttctacgagccccagattatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgctagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23694 - RNA, 4185 nt, synthetic construct
  misc_feature 1..4185: note = SARS-CoV-2/Wuhan/WIV05/2019__EPI_ISL_402128 spike protein mRNA gc (1-1273)(H69del_V70del_Y453F_D614G_I692V_M1229I)
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgccccacacggcgtggtgttcctccacgtcacatacgtgcccgcccaggagaagaacttcaccaccgcccccgccatctgccacgacggcaaggctcacttcccccgggagggagtgttcgtgagcaacggcacccactggttcgtgacccagcggaacttctacgagccccagattatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23695 - RNA, 4182 nt, synthetic construct
  misc_feature 1..4182: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4182: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgacgacaccaccgacgccgtgcgggacccccagaccctggagatcctggacatcaccccatgcagcttcggcggcgtgagcgtgatcacccccggcacaaacaccagcaaccaggtcgcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagccaccggcgggcccggagcgtggccagccagagcatcatcgcctacaccatgagcttaggcgccgagaacagcgtggcctacagcaacaacagcatcgccatccccatcaacttcaccataagcgtgaccaccgagatcctgcctgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagaccccacccatcaaggacttcggcggcttcaacttcagccagatcctgcccgaccccagcaagcccagcaagcggagcttcatcgaggacctgctgttcaacaaggtgactctggccgacgccggcttcatcaagcagtacggcgattgcctgggggacatcgccgcccgggacctgatctgcgctcagaagttcaacggcctgaccgtgctgcctcccctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaacgacatcctggccaggctggacaaggtggaggccgaggtgcagatcgaccggctgatcaccggccggctgcagagcctgcagacctacgtgacccagcagctgatccgggccgccgagattcgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacctacgtcccagcccaggagaagaacttcacaaccgcccccgccatctgccacgacggcaaggcccacttcccccgggagggagtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgaccccctgcagcccgagctggacagcttcaaggaggagctggacaagtacttcaagaaccacaccagccctgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23696 - RNA, 4191 nt, synthetic construct
  misc_feature 1..4191: note = SARS-CoV-2/Wuhan/WIV05/2019__EPI_ISL_402128 spike protein mRNA gc (1-1273)(K417N_E484K_N501Y_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23697 - RNA, 4182 nt, synthetic construct
  misc_feature 1..4182: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4182: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacttcaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgccaacccagtgctgcccttcaacgacggcgtgtacttcgccagcaccgagaagtcaaacatcatccggggctggatctttggcaccaccctggacagcaagacacagagcctgctgatcgtgaacaacgctaccaacgtggtgatcaaggtgtgcgagttccagttctgcaacgaccccttcctgggcgtgtactaccacaagaacaacaagagctggatggagagcgagttccgggtctacagcagcgccaacaattgcaccttcgagtacgtgagccagcccttcctgatggacctggagggcaagcagggcaacttcaagaacctccgggagttcgtgttcaagaacatcgacggctacttcaagatctacagcaagcacacccccatcaacctggtgcggggactgccccagggcttcagcgccctggagcctctggtggatctgcccatcggcatcaacatcaccaggttccagaccctgcacatcagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcacccttaagagcttcaccgtggagaagggcatctaccagaccagcaacttccgggtgcagcccactgagagcattgtgcggttccccaacatcaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctattccgtaagagcaacctgaagccatttgagcgggacatcagcaccgagatctaccaggccggtagcaccccctgcaacggcgtgaagggcttcaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggacatcgccgacaccaccgatgcagtgcgggacccccagaccctggagatcctggacatcaccccatgcagcttcggcggcgtgagcgtcatcacccccggaacaaacaccagcaaccaggtggccgtgctgtaccagggcgtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcctgggcgtggagaacagcgtggcctacagcaacaacagcatcgccatccctaccaacttcaccataagcgtgaccaccgagatcctgcccgtgagcatgaccaagaccagcgtggactgtaccatgtacatctgcggcgacagcaccgagtgcagcaacctgttactgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggggactgcctgggcgacatcgccgcccgggacctgatctgcgctcagaagttcaacggcctgaccgtgctgccccctctgctgaccgatgagatgatcgcccagtacaccagcgccctgctggccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaactttggcgccatcagctcagtgctgaatgacatcctgagccggctggacaaggtggaggccgaggtgcagatcgacaggctgatcaccggccggctgcagagcctgcagacctacgtgacccagcagctgatccgggccgccgagattcgggccagcgccaacctggccgcaaccaagatgagcgagtgcgtgctgggccagagcaagcgggtggacttctgcggcaagggctaccacctgatgagcttcccccagagcgccccacacggcgtggtcttcctgcacgtgacatacgtgcccgcccaggagaagaacttcaccaccgcccccgccatctgccacgacggaaaggcccacttcccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctcgacaagtacttcaagaaccacaccagccccgacgtggacctgggcgacatcagcggcatcaacgctagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23698 - RNA, 4191 nt, synthetic construct
  misc_feature 1..4191: note = SARS-CoV-2/Wuhan/WIV05/2019__EPI_ISL_402128 spike protein mRNA gc (1-1273)(E484K_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23699 - RNA, 4191 nt, synthetic construct
  misc_feature 1..4191: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacttcaccaaccggacccagctgcccagcgcctacaccaacagcttcacccggggcgtgtactaccctgacaaggtgttccggagcagcgtgctgcacagcacccaggacctgttcctgcccttcttcagcaacgtgacctggttccacgccatccacgtgagcggcaccaacggcaccaagcggttcgacaaccccgtgctgccattcaacgacggcgtgtacttcgccagcaccgagaagtcaaacatcatccggggctggatctttggcaccaccctggacagcaagacccagagcctgctgatcgtgaacaacgccacaaacgtggtgatcaaggtgtgcgagttccagttctgcaactaccccttcctgggcgtgtactaccacaagaacaacaagagctggatggagagcgagttccgggtctacagcagcgctaataactgcaccttcgagtacgtgagccagcccttcctgatggacctggagggcaagcagggcaacttcaagaacctcagcgagttcgtgttcaagaacatcgacggctacttcaagatctacagcaagcacacccccatcaacctggtgcgggatctgccccagggattcagcgccctggagcccctggtggacctgcctatcggcatcaacatcacccggttccagaccctgctggccctgcacaggagctacctgacccccggcgacagcagcagcggctggaccgccggcgccgccgcatactacgtgggctacctgcagccccggaccttcctgctgaagtacaacgagaacggcaccatcaccgacgccgtggactgcgccctggacccactgagcgagaccaagtgcaccctaaagagcttcaccgtggagaagggcatctaccagaccagcaacttccgggtgcagcccaccgagagcatcgtgcggttccccaacattactaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgctgacagcttcgtgatccggggcgacgaggtgcggcagatcgcccctggccagaccggcaccatcgccgactacaactacaagctgcccgacgacttcaccggctgcgtgatcgcctggaacagcaacaacctggacagcaaggtgggcggcaactacaactacctgtaccggctgttccgtaagagcaacctgaagccctttgagcgggacatcagcaccgagatctaccaggccggcagcaccccatgcaacggtgtgaagggcttcaactgctacttccccctgcagagctacggcttccagcccacctacggcgtgggctaccagccctaccgggtggtggtgctgagcttcgagctgctgcacgcccccgccaccgtgtgcggccccaaaaagagcaccaacctggtgaagaacaagtgcgtgaacttcaatttcaacggcctgaccggcaccggcgtgctgaccgagagcaacaagaagttcctgcctttccagcagttcggccgggacatcgccgataccaccgacgcagtgcgggacccccagaccctggagatcctggacatcaccccctgcagcttcggcggcgtgagcgtcatcaccccaggcacaaacaccagcaaccaggtggccgtgctgtaccagggagtgaactgcaccgaggtgcccgtggccatccacgccgaccagctgacccccacctggcgggtgtactccaccggcagcaacgtgttccagacccgggccggctgcctgatcggcgccgagtacgtgaacaacagctacgagtgcgacatccccatcggcgctggcatctgcgccagctaccagacccagaccaacagcccccggcgggcccggagcgtggccagccagagcatcatcgcctacaccatgagcctgggcgccgagaacagcgtggcctacagcaacaacagcatcgcgatccccaccaacttcaccatcagcgtgaccaccgagatattacctgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactccacccatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggacatcgccgctcgggatctgatctgcgcccagaagttcaacggcctgaccgtgctgcctcccctgctgaccgacgagatgatcgcccagtacaccagcgccctgctggccggcaccatcaccagcggctggaccttcggcgccggcgcagcccttcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagctcaaactttggcgccatcagcagcgtgctgaatgacatcctgagccggctggacaaggtggaggccgaggtgcagatcgacaggctgatcaccggccggctgcagagcctgcagacctacgtgacccagcagctgatccgggccgccgagatccgggccagcgccaacctggcagccattaagatgagcgagtgcgtgctgggccagagcaagcgggtggacttctgcggcaagggctaccacctgatgagcttcccccagagcgctccccacggcgtggtgttcctgcacgtcacctacgtgccagcccaggagaagaacttcacaaccgcccccgccatctgccacgacggcaaggcccacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctccagcccgagctggacagcttcaaggaggagctggacaagtacttcaagaaccacaccagccctgacgtggacctgggcgatatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23700 - RNA, 4191 nt, synthetic construct
  misc_feature 1..4191: note = SARS-CoV-2/Wuhan/WIV05/2019__EPI_ISL_402128 spike protein mRNA gc (1-1273)(S13I_W152C_L452R_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcatccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctgcatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgtaccctaaagagcttcaccgtggagaagggcatctaccagaccagcaacttccgggtgcagcccactgagagcattgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactaccggtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgtgcctcctaccagacccagaccaacagcccccggcgggcccggagcgtggccagccagagcatcatcgcctacaccatgagcctgggcgccgagaacagcgtggcctacagcaacaacagcatcgcgatccctaccaacttcaccataagcgtgaccaccgagatcttacccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgctggccggcaccatcaccagcggctggaccttcggcgccggcgcagcccttcagatccccttcgccatgcagatggcctacaggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagcagcgtgctgaatgacatcctgtcacggctggacaaggtggaggccgaggtgcagatcgaccggctgatcaccggccggctgcagagcctgcagacctacgtgacccagcagctgatccgggccgccgagattcgggccagcgccaacctggcagccaccaagatgagcgagtgcgtgctgggccagagcaagcgggtggacttttgcggcaagggctaccacctgatgagcttcccccagagcgccccacacggcgtggtgttcctgcacgtcacatacgtgcccgcccaggagaagaacttcaccaccgcccccgccatctgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctccagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgttgcagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23701 - RNA, 4191 nt, synthetic construct
  misc_feature 1..4191: note = SARS-CoV-2/Wuhan/WIV05/2019__EPI_ISL_402128 spike protein mRNA gc mod (1-1273)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23702 - RNA, 4191 nt, synthetic construct
  misc_feature 1..4191: note = SARS-CoV-2/Wuhan/WIV05/2019__EPI_ISL_402128 spike protein mRNA gc mod (1-1273)(D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23703 - RNA, 4191 nt, synthetic construct
  misc_feature 1..4191: note = SARS-CoV-2/Wuhan/WIV05/2019__EPI_ISL_402128 spike protein mRNA gc mod (1-1273)(A222V_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23704 - RNA, 4191 nt, synthetic construct
  misc_feature 1..4191: note = SARS-CoV-2/Wuhan/WIV05/2019__EPI_ISL_402128 spike protein mRNA gc mod (1-1273)(N439K_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23705 - RNA, 4191 nt, synthetic construct
  misc_feature 1..4191: note = SARS-CoV-2/Wuhan/WIV05/2019__EPI_ISL_402128 spike protein mRNA gc mod (1-1273)(S477N_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23706 - RNA, 4191 nt, synthetic construct
  misc_feature 1..4191: note = SARS-CoV-2/Wuhan/WIV05/2019__EPI_ISL_402128 spike protein mRNA gc mod (1-1273)(N501Y_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23707 - RNA, 4185 nt, synthetic construct
  misc_feature 1..4185: note = SARS-CoV-2/Wuhan/WIV05/2019__EPI_ISL_402128 spike protein mRNA gc mod (1-1273)(H69del_V70del_D614G)
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23708 - RNA, 4191 nt, synthetic construct
  misc_feature 1..4191: note = SARS-CoV-2/Wuhan/WIV05/2019__EPI_ISL_402128 spike protein mRNA gc mod (1-1273)(Y453F_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23709 - RNA, 4191 nt, synthetic construct
  misc_feature 1..4191: note = SARS-CoV-2/Wuhan/WIV05/2019__EPI_ISL_402128 spike protein mRNA gc mod (1-1273)(D614G_I692V)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23710 - RNA, 4191 nt, synthetic construct
  misc_feature 1..4191: note = SARS-CoV-2/Wuhan/WIV05/2019__EPI_ISL_402128 spike protein mRNA gc mod (1-1273)(D614G_M1229I)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23711 - RNA, 4185 nt, synthetic construct
  misc_feature 1..4185: note = SARS-CoV-2/Wuhan/WIV05/2019__EPI_ISL_402128 spike protein mRNA gc mod (1-1273)(H69del_V70del_A222V_Y453F_S477N_D614G_I692V)
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23712 - RNA, 4185 nt, synthetic construct
  misc_feature 1..4185: note = SARS-CoV-2/Wuhan/WIV05/2019__EPI_ISL_402128 spike protein mRNA gc mod (1-1273)(H69del_V70del_Y453F_D614G_I692V_M1229I)
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23713 - RNA, 4182 nt, synthetic construct
  misc_feature 1..4182: note = SARS-CoV-2/Wuhan/WIV05/2019__EPI_ISL_402128 spike protein mRNA gc mod (1-1273)(H69del_V70del_Y144del_N501Y_A570D_D614G_P681H_T716 I_S982A_D1118H)
  source 1..4182: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccacagacgggctagaagcgtggccagccagagcatcattgcctacacaatgtctctgggcgccgagaacagcgtggcctactccaacaactctatcgctatccccatcaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23714 - RNA, 4191 nt, synthetic construct
  misc_feature 1..4191: note = SARS-CoV-2/Wuhan/WIV05/2019__EPI_ISL_402128 spike protein mRNA gc mod (1-1273)(K417N_E484K_N501Y_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23715 - RNA, 4182 nt, synthetic construct
  misc_feature 1..4182: note = SARS-CoV-2/Wuhan/WIV05/2019__EPI_ISL_402128 spike protein mRNA gc mod (1-1273)(L18F_D80A_D215G_L242del_A243del_L244del_R246I_K417 N_E484K_N501Y_D614G_A701V)
  source 1..4182: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacttcaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgtggagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23716 - RNA, 4191 nt, synthetic construct
  misc_feature 1..4191: note = SARS-CoV-2/Wuhan/WIV05/2019__EPI_ISL_402128 spike protein mRNA gc mod (1-1273)(E484K_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23717 - RNA, 4191 nt, synthetic construct
  misc_feature 1..4191: note = SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G _H655Y_T1027I)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacttcaccaacagaacacagctgcctagcgcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23718 - RNA, 4191 nt, synthetic construct
  misc_feature 1..4191: note = SARS-CoV-2/Wuhan/WIV05/2019__EPI_ISL_402128 spike protein mRNA gc mod (1-1273)(S13I_W152C_L452R_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccatccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23719 - RNA, 4191 nt, synthetic construct
  misc_feature 1..4191: note = SARS-CoV-2/Wuhan/WIV05/2019__EPI_ISL_402128 spike protein mRNA gc mod (1-1273)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23720 - RNA, 4191 nt, synthetic construct
  misc_feature 1..4191: note = SARS-CoV-2/Wuhan/WIV05/2019__EPI_ISL_402128 spike protein mRNA gc mod (1-1273)(D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23721 - RNA, 4191 nt, synthetic construct
  misc_feature 1..4191: note = SARS-CoV-2/Wuhan/WIV05/2019__EPI_ISL_402128 spike protein mRNA gc mod (1-1273)(A222V_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23722 - RNA, 4191 nt, synthetic construct
  misc_feature 1..4191: note = SARS-CoV-2/Wuhan/WIV05/2019__EPI_ISL_402128 spike protein mRNA gc mod (1-1273)(N439K_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23723 - RNA, 4191 nt, synthetic construct
  misc_feature 1..4191: note = SARS-CoV-2/Wuhan/WIV05/2019__EPI_ISL_402128 spike protein mRNA gc mod (1-1273)(S477N_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23724 - RNA, 4191 nt, synthetic construct
  misc_feature 1..4191: note = SARS-CoV-2/Wuhan/WIV05/2019__EPI_ISL_402128 spike protein mRNA gc mod (1-1273)(N501Y_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23725 - RNA, 4185 nt, synthetic construct
  misc_feature 1..4185: note = SARS-CoV-2/Wuhan/WIV05/2019__EPI_ISL_402128 spike protein mRNA gc mod (1-1273)(H69del_V70del_D614G)
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23726 - RNA, 4191 nt, synthetic construct
  misc_feature 1..4191: note = SARS-CoV-2/Wuhan/WIV05/2019__EPI_ISL_402128 spike protein mRNA gc mod (1-1273)(Y453F_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23727 - RNA, 4191 nt, synthetic construct
  misc_feature 1..4191: note = SARS-CoV-2/Wuhan/WIV05/2019__EPI_ISL_402128 spike protein mRNA gc mod (1-1273)(D614G_I692V)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23728 - RNA, 4191 nt, synthetic construct
  misc_feature 1..4191: note = SARS-CoV-2/Wuhan/WIV05/2019__EPI_ISL_402128 spike protein mRNA gc mod (1-1273)(D614G_M1229I)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23729 - RNA, 4185 nt, synthetic construct
  misc_feature 1..4185: note = SARS-CoV-2/Wuhan/WIV05/2019__EPI_ISL_402128 spike protein mRNA gc mod (1-1273)(H69del_V70del_A222V_Y453F_S477N_D614G_I692V)
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23730 - RNA, 4185 nt, synthetic construct
  misc_feature 1..4185: note = SARS-CoV-2/Wuhan/WIV05/2019__EPI_ISL_402128 spike protein mRNA gc mod (1-1273)(H69del_V70del_Y453F_D614G_I692V_M1229I)
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23731 - RNA, 4182 nt, synthetic construct
  misc_feature 1..4182: note = SARS-CoV-2/Wuhan/WIV05/2019__EPI_ISL_402128 spike protein mRNA gc mod (1-1273)(H69del_V70del_Y144del_N501Y_A570D_D614G_P681H_T716 I_S982A_D1118H)
  source 1..4182: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccaccggagagccagaagcgtggccagccagagcatcattgcctacacaatgtctctgggcgccgagaacagcgtggcctactccaacaactctatcgctatccccatcaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23732 - RNA, 4191 nt, synthetic construct
  misc_feature 1..4191: note = SARS-CoV-2/Wuhan/WIV05/2019__EPI_ISL_402128 spike protein mRNA gc mod (1-1273)(K417N_E484K_N501Y_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23733 - RNA, 4182 nt, synthetic construct
  misc_feature 1..4182: note = SARS-CoV-2/Wuhan/WIV05/2019__EPI_ISL_402128 spike protein mRNA gc mod (1-1273)(L18F_D80A_D215G_L242del_A243del_L244del_R246I_K417 N_E484K_N501Y_D614G_A701V)
  source 1..4182: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacttcaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgtggagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23734 - RNA, 4191 nt, synthetic construct
  misc_feature 1..4191: note = SARS-CoV-2/Wuhan/WIV05/2019__EPI_ISL_402128 spike protein mRNA gc mod (1-1273)(E484K_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23735 - RNA, 4191 nt, synthetic construct
  misc_feature 1..4191: note = SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G _H655Y_T1027I)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacttcaccaacagaacacagctgcctagcgcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23736 - RNA, 4191 nt, synthetic construct
  misc_feature 1..4191: note = SARS-CoV-2/Wuhan/WIV05/2019__EPI_ISL_402128 spike protein mRNA gc mod (1-1273)(S13I_W152C_L452R_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccatccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23737 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P) R10183
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23738 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_ D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23739 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_A222V_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23740 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_N439K_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23741 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_S477N_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23742 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_N501Y_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23743 - RNA, 4185 nt, synthetic construct
  misc_feature 1..4185: note = SARS-CoV-2/Wuhan/WIV05/2019__EPI_ISL_402128 spike protein mRNA gc (1-1273)(K986P_V987P_H69del_V70del_D614G)
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23744 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_Y453F_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23745 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_D614G_I692V)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23746 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_D614G_M1229I)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23747 - RNA, 4185 nt, synthetic construct
  misc_feature 1..4185: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23748 - RNA, 4185 nt, synthetic construct
  misc_feature 1..4185: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtgatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23749 - RNA, 4182 nt, synthetic construct
  misc_feature 1..4182: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4182: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgacgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactcccaccggcgcgcccggagcgtggcgtcccagagcatcatcgcctacaccatgtccctgggcgccgagaacagcgtcgcctactccaacaacagcatcgccatccccatcaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctcgcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccacccacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23750 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23751 - RNA, 4182 nt, synthetic construct
  misc_feature 1..4182: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4182: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacttcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgccaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccggggcctgccccaggggttcagcgccctcgagcccctggtggacctgcccatcggcatcaacatcacccgcttccagaccctccacatctcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgtggagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23752 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_K986P_V987P_E484K_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23753 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacttcaccaaccgcacgcagctgccgagcgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaactaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctcagcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaccatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgatcaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23754 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagcatccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctgcatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactaccgctaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23755 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtccagatcgaccggctgatcaccgggcgcctccagagcctgcagacctacgtgacccagcagctgatccgggcggccgagatccgcgccagcgccaacctcgccgcgaccaagatgtccgagtgcgtgctgggccagagcaagcgggtcgacttctgcggcaaggggtaccacctgatgtccttcccccagagcgcgccccacggcgtggtgttcctccacgtcacgtacgtgcccgcccaggagaagaacttcaccaccgccccggccatctgccacgacgggaaggcccacttcccccgcgagggcgtcttcgtgtccaacgggacccactggttcgtgacgcagcggaacttctacgagccccagatcatcaccaccgacaacaccttcgtcagcggcaactgcgacgtggtgatcggcatcgtcaacaacacggtgtacgaccccctgcagccggagctggactccttcaaggaggagctcgacaagtacttcaagaaccacaccagccccgacgtggacctgggggacatctccggcatcaacgccagcgtcgtgaacatccagaaggagatcgaccgcctgaacgaggtggccaagaacctcaacgagtccctgatcgacctgcaggagctcgggaagtacgagcagtacatcaagtggccctggtacatctggctgggcttcatcgccggcctgatcgcgatcgtcatggtgaccatcatgctctgctgcatgaccagctgctgctcctgcctgaaggggtgctgcagctgcggctcctgctgcaagttcgacgaggacgacagcgagccggtgctgaagggggtcaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23756 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_ D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23757 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_A222V_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtgctcgagcccctggtggacctgcccatcggcatcaacatcacccgcttccagaccctcctggccctgcaccggtcctacctcacgccgggggacagcagctccggctggaccgccggcgcggccgcctactacgtcgggtacctgcagccccgcaccttcctgctcaagtacaacgagaacggcaccatcacggacgccgtggactgcgcgctggaccccctgagcgagaccaagtgcaccctcaagtccttcaccgtggagaaggggatctaccagacgagcaacttccgggtccagcccaccgagtccatcgtgcgcttcccgaacatcaccaacctgtgccccttcggcgaggtcttcaacgccacccggttcgccagcgtgtacgcctggaaccgcaagcggatctccaactgcgtggccgactacagcgtcctgtacaactccgcgagcttctccacgttcaagtgctacggcgtgagccccaccaagctcaacgacctgtgcttcaccaacgtgtacgccgactccttcgtcatccgcggggacgaggtgcggcagatcgcccccggccagaccgggaagatcgccgactacaactacaagctgccggacgacttcacgggctgcgtgatcgcctggaacagcaacaacctcgactccaaggtcgggggcaactacaactacctgtaccgcctgttccgcaagagcaacctcaagcccttcgagcgggacatctccaccgagatctaccaggcgggcagcaccccctgcaacggggtggagggcttcaactgctacttccccctgcagtcctacgggttccagccgaccaacggcgtggggtaccagccctaccgggtcgtggtgctgagcttcgagctcctgcacgcccccgccacggtctgcggccccaagaagtccaccaacctggtgaagaacaagtgcgtgaacttcaacttcaacggcctcaccgggaccggcgtcctgaccgagagcaacaagaagttcctgccgttccagcagttcgggcgcgacatcgccgacacgaccgacgccgtgcgcgacccccagaccctggagatcctcgacatcaccccctgcagcttcggcggggtgtccgtcatcacgccgggcaccaacaccagcaaccaggtggcggtgctgtaccagggcgtcaactgcaccgaggtgcccgtggccatccacgccgaccagctgacgcccacctggcgggtctactccaccgggagcaacgtgttccagacccgcgccggctgcctcatcggggccgagcacgtgaacaactcctacgagtgcgacatccccatcggcgcgggcatctgcgccagctaccagacgcagaccaactccccgcggcgcgcccggagcgtcgcctcccagagcatcatcgcgtacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgccctgacgggcatcgcggtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacccgcccgaggccgaggtgcagatcgaccggctgatcaccggccgcctccagagcctgcagacctacgtgacccagcagctgatccgggccgcggagatccgcgccagcgccaacctcgccgccaccaagatgtccgagtgcgtcctgggccagagcaagcgggtggacttctgcgggaagggctaccacctgatgtccttcccccagagcgcgccccacggggtggtcttcctccacgtgacgtacgtccccgcccaggagaagaacttcaccaccgccccggccatctgccacgacggcaaggcgcacttcccccgcgagggggtgttcgtgtccaacggcacccactggttcgtcacgcagcggaacttctacgagccccagatcatcaccaccgacaacaccttcgtgagcggcaactgcgacgtggtcatcgggatcgtgaacaacacggtgtacgaccccctgcagccggagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccctggtacatctggctgggcttcatcgccgggctgatcgccatcgtgatggtgaccatcatgctctgctgcatgaccagctgctgctcctgcctgaagggctgctgcagctgcgggtcctgctgcaagttcgacgaggacgacagcgagccggtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23758 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_N439K_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23759 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_S477N_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgagcgtgatcacgccgggcaccaacacctccaaccaggtcgccgtgctgtaccagggcgtgaactgcaccgaggtccccgtggccatccacgccgaccagctgacgcccacctggcgggtgtacagcaccgggtccaacgtcttccagacccgcgccggctgcctcatcggggcggagcacgtgaacaacagctacgagtgcgacatccccatcggcgccggcatctgcgcctcctaccagacgcagaccaacagcccgcggcgcgcccggtccgtggcgagccagtccatcatcgcctacaccatgagcctgggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctcctgctgcagtacgggagcttctgcacccagctcaaccgcgcgctgacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacacctccgccctcctggcgggcaccatcacgagcgggtggaccttcggcgccggcgccgccctgcagatccccttcgcgatgcagatggcctaccggttcaacgggatcggcgtcacccagaacgtgctctacgagaaccagaagctgatcgccaaccagttcaactccgccatcgggaagatccaggacagcctgtccagcaccgcctccgcgctcggcaagctgcaggacgtggtcaaccagaacgcccaggccctgaacacgctcgtgaagcagctgagctccaacttcggggccatcagctccgtgctgaacgacatcctcagccgcctggacccgcccgaggccgaggtccagatcgaccggctgatcaccggccgcctccagtccctgcagacctacgtgacccagcagctgatccgggcggccgagatccgcgccagcgccaacctcgccgcgaccaagatgagcgagtgcgtgctgggccagtccaagcgggtcgacttctgcgggaagggctaccacctgatgagcttcccccagtccgcgccccacggggtggtgttcctccacgtcacgtacgtgcccgcccaggagaagaacttcaccaccgccccggccatctgccacgacggcaaggcccacttcccccgcgagggggtcttcgtgagcaacggcacccactggttcgtgacgcagcggaacttctacgagccccagatcatcaccaccgacaacaccttcgtctccggcaactgcgacgtggtgatcgggatcgtcaacaacacggtgtacgaccccctgcagccggagctggacagcttcaaggaggagctcgacaagtacttcaagaaccacacctcccccgacgtggacctgggcgacatcagcgggatcaacgcctccgtcgtgaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtcatggtgaccatcatgctctgctgcatgacctcctgctgcagctgcctgaagggctgctgctcctgcgggagctgctgcaagttcgacgaggacgactccgagccggtgctgaagggcgtcaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23760 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_N501Y_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23761 - RNA, 4185 nt, synthetic construct
  misc_feature 1..4185: note = SARS-CoV-2/Wuhan/WIV05/2019__EPI_ISL_402128 spike protein mRNA gc (1-1273)(K986P_V987P_H69del_V70del_D614G)
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtggcctactccaacaacagcatcgccatccccaccaacttcacgatctccgtcaccaccgagatcctgcccgtgagcatgaccaagacgagcgtggactgcaccatgtacatctgcggcgactccaccgagtgcagcaacctcctgctgcagtacgggtccttctgcacccagctcaaccgcgcgctgacgggcatcgccgtcgagcaggacaagaacacccaggaggtgttcgcccaggtgaagcagatctacaagacgcccccgatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtcctctacgagaaccagaagctgatcgccaaccagttcaacagcgccatcgggaagatccaggactccctgagctccaccgccagcgcgctcggcaagctgcaggacgtggtgaaccagaacgcccaggccctgaacacgctcgtcaagcagctgtccagcaacttcggggccatctccagcgtgctgaacgacatcctctcccgcctggacccgcccgaggccgaggtgcagatcgaccggctgatcaccggccgcctccagagcctgcagacctacgtcacccagcagctgatccgggcggccgagatccgcgccagcgccaacctcgccgcgaccaagatgtccgagtgcgtgctgggccagagcaagcgggtggacttctgcgggaagggctaccacctgatgtccttcccccagagcgcgccccacggggtcgtgttcctccacgtgacgtacgtccccgcccaggagaagaacttcaccaccgccccggccatctgccacgacggcaaggcccacttcccccgcgagggggtgttcgtctccaacggcacccactggttcgtgacgcagcggaacttctacgagccccagatcatcaccaccgacaacaccttcgtgagcggcaactgcgacgtcgtgatcgggatcgtgaacaacacggtctacgaccccctgcagccggagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtgatggtcaccatcatgctctgctgcatgaccagctgctgctcctgcctgaagggctgctgcagctgcgggtcctgctgcaagttcgacgaggacgacagcgagccggtgctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23762 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_Y453F_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23763 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_D614G_I692V)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcgtcatcgcctacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgcgctgacgggcatcgccgtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtcctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtgctctacgagaaccagaagctgatcgccaaccagttcaacagcgccatcgggaagatccaggactccctgagctccaccgccagcgcgctcggcaagctgcaggacgtcgtgaaccagaacgcccaggccctgaacacgctcgtgaagcagctgtccagcaacttcggggccatctccagcgtcctgaacgacatcctctcccgcctggacccgcccgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgcgccccacggggtggtcttcctccacgtgacgtacgtccccgcccaggagaagaacttcaccaccgccccggccatctgccacgacggcaaggcccacttcccccgcgagggggtgttcgtgtccaacggcacccactggttcgtcacgcagcggaacttctacgagccccagatcatcaccaccgacaacaccttcgtgagcggcaactgcgacgtggtcatcgggatcgtgaacaacacggtgtacgaccccctgcagccggagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccctggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagccggtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23764 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_D614G_M1229I)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatcgtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23765 - RNA, 4185 nt, synthetic construct
  misc_feature 1..4185: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgtcctcgagcccctggtggacctgcccatcggcatcaacatcacccgcttccagaccctcctggccctgcaccggtcctacctcacgccgggggacagcagctccggctggaccgccggcgcggccgcctactacgtggggtacctgcagccccgcaccttcctgctcaagtacaacgagaacggcaccatcacggacgccgtcgactgcgcgctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggccgactacagcgtgctgtacaactccgcgagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcctggaacagcaacaacctcgactccaaggtcgggggcaactacaactacctgttccgcctgttccgcaagagcaacctcaagcccttcgagcgggacatctccaccgagatctaccaggcgggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgccgtccgcgacccccagaccctggagatcctcgacatcaccccctgcagcttcggcggggtgagcgtgatcacgccgggcaccaacacctccaaccaggtcgcggtgctgtaccagggcgtgaactgcaccgaggtccccgtggccatccacgccgaccagctgacgcccacctggcgggtgtacagcaccgggtccaacgtcttccagacccgcgccggctgcctcatcggggccgagcacgtgaacaacagctacgagtgcgacatccccatcggcgcgggcatctgcgcctcctaccagacgcagaccaacagcccgcggcgcgcccggtccgtggccagccagtccgtcatcgcgtacaccatgagcctgggggccgagaactccgtggcctacagcaacaactccatcgccatccccaccaacttcacgatcagcgtgaccaccgagatcctgcccgtctccatgaccaagacgagcgtggactgcaccatgtacatctgcggcgacagcaccgagtgctccaacctcctgctgcagtacgggagcttctgcacccagctcaaccgcgccctgacgggcatcgcggtggagcaggacaagaacacccaggaggtcttcgcccaggtgaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacacctccgccctcctggccggcaccatcacgagcgggtggaccttcggcgcgggcgccgccctgcagatccccttcgccatgcagatggcgtaccggttcaacgggatcggcgtgacccagaacgtgctctacgagaaccagaagctgatcgccaaccagttcaactccgccatcgggaagatccaggacagcctgtccagcaccgcctccgccctcggcaagctgcaggacgtcgtgaaccagaacgcgcaggccctgaacacgctcgtgaagcagctgagctccaacttcggggccatcagctccgtcctgaacgacatcctcagccgcctggacccgcccgaggccgaggtgcagatcgaccggctgatcaccggccgcctccagtccctgcagacctacgtgacccagcagctgatccgggccgcggagatccgcgccagcgccaacctcgccgccaccaagatgagcgagtgcgtcctgggccagtccaagcgggtggacttctgcgggaagggctaccacctgatgagcttcccccagtccgcgccccacggggtggtcttcctccacgtgacgtacgtccccgcccaggagaagaacttcaccaccgccccggccatctgccacgacggcaaggcgcacttcccccgcgagggggtgttcgtgagcaacggcacccactggttcgtcacgcagcggaacttctacgagccccagatcatcaccaccgacaacaccttcgtgtccggcaactgcgacgtggtcatcgggatcgtgaacaacacggtgtacgaccccctgcagccggagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccctggtacatctggctgggcttcatcgccgggctgatcgccatcgtgatggtgaccatcatgctctgctgcatgacctcctgctgcagctgcctgaagggctgctgctcctgcgggagctgctgcaagttcgacgaggacgactccgagccggtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23766 - RNA, 4185 nt, synthetic construct
  misc_feature 1..4185: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcgtgatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatcgtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23767 - RNA, 4182 nt, synthetic construct
  misc_feature 1..4182: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4182: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgacgacacgaccgacgccgtgcgcgacccccagaccctggagatcctcgacatcaccccctgcagcttcggcggggtctccgtgatcacgccgggcaccaacaccagcaaccaggtggcggtcctgtaccagggcgtgaactgcaccgaggtgcccgtcgccatccacgccgaccagctgacgcccacctggcgggtgtactccaccgggagcaacgtgttccagacccgcgccggctgcctcatcggggccgagcacgtcaacaactcctacgagtgcgacatccccatcggcgcgggcatctgcgccagctaccagacgcagaccaactcccaccggcgcgcccggagcgtggcctcccagagcatcatcgcgtacaccatgtccctgggggccgagaacagcgtggcctactccaacaacagcatcgccatcccgatcaacttcaccatctccgtcacgaccgagatcctgcccgtgagcatgaccaagaccagcgtggactgcacgatgtacatctgcggcgactccaccgagtgcagcaacctcctgctgcagtacgggtccttctgcacccagctcaaccgcgccctgaccggcatcgcggtcgagcaggacaagaacacgcaggaggtgttcgcccaggtgaagcagatctacaagaccccgcccatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgccgcgcgcgacctgatctgcgcccagaagttcaacgggctgaccgtgctgcccccgctcctgacggacgagatgatcgcccagtacaccagcgccctcctggccggcaccatcacctccgggtggacgttcggcgcgggcgccgccctgcagatccccttcgccatgcagatggcgtaccggttcaacgggatcggcgtgacccagaacgtcctctacgagaaccagaagctgatcgccaaccagttcaacagcgccatcgggaagatccaggactccctgagctccaccgccagcgccctcggcaagctgcaggacgtggtgaaccagaacgcgcaggccctgaacaccctcgtcaagcagctgtccagcaacttcggggccatctccagcgtgctgaacgacatcctcgcccgcctggacccgcccgaggccgaggtgcagatcgaccggctgatcacgggccgcctccagtccctgcagacctacgtcacccagcagctgatccgggcggccgagatccgcgccagcgccaacctcgccgcgaccaagatgagcgagtgcgtgctgggccagtccaagcgggtggacttctgcgggaagggctaccacctgatgagcttcccccagtccgcgccccacggggtcgtgttcctccacgtgacctacgtccccgcccaggagaagaacttcacgaccgcccccgccatctgccacgacggcaaggcccacttcccgcgcgagggggtgttcgtcagcaacggcacccactggttcgtgacccagcggaacttctacgagccccagatcatcacgacccacaacaccttcgtgtccggcaactgcgacgtcgtgatcgggatcgtgaacaacaccgtctacgaccccctgcagcccgagctggacagcttcaaggaggagctcgacaagtacttcaagaaccacacgtccccggacgtggacctgggcgacatcagcgggatcaacgcctccgtggtcaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtgatggtcaccatcatgctctgctgcatgacctcctgctgcagctgcctgaagggctgctgctcctgcgggagctgctgcaagttcgacgaggacgactccgagcccgtgctgaagggcgtgaagctccactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23768 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23769 - RNA, 4182 nt, synthetic construct
  misc_feature 1..4182: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4182: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacttcaccacccgcacgcagctcccgcccgcctacaccaacagcttcacccggggcgtctactaccccgacaaggtgttccgctccagcgtgctgcactccacccaggacctgttcctccccttcttcagcaacgtcacgtggttccacgccatccacgtgtccgggaccaacggcaccaagcggttcgcgaacccggtgctgcccttcaacgacggggtctacttcgccagcaccgagaagtccaacatcatccgcggctggatcttcgggacgaccctggacagcaagacccagtccctcctgatcgtgaacaacgccaccaacgtggtcatcaaggtgtgcgagttccagttctgcaacgaccccttcctgggcgtgtactaccacaagaacaacaagagctggatggagtccgagttccgggtctacagctccgccaacaactgcacgttcgagtacgtgagccagcccttcctcatggacctggagggcaagcaggggaacttcaagaacctgcgcgagttcgtgttcaagaacatcgacggctacttcaagatctactccaagcacaccccgatcaacctcgtccgggggctgccccagggcttcagcgccctggagcccctcgtggacctgcccatcgggatcaacatcacccgcttccagaccctgcacatctcctacctcacgccgggcgacagcagctccggctggaccgcgggggccgccgcctactacgtgggctacctgcagccccggaccttcctgctcaagtacaacgagaacgggaccatcacggacgcggtcgactgcgccctggaccccctgagcgagaccaagtgcaccctcaagtccttcaccgtggagaagggcatctaccagacgagcaacttccgcgtgcagcccaccgagtccatcgtccggttcccgaacatcaccaacctgtgccccttcggcgaggtgttcaacgccacccgcttcgccagcgtctacgcctggaaccggaagcgcatctccaactgcgtggcggactacagcgtgctgtacaactccgccagcttctccacgttcaagtgctacggggtcagccccaccaagctcaacgacctgtgcttcaccaacgtgtacgccgactccttcgtgatccggggcgacgaggtccgccagatcgcccccgggcagaccggcaacatcgccgactacaactacaagctgccggacgacttcacggggtgcgtgatcgcgtggaacagcaacaacctcgactccaaggtgggcggcaactacaactacctgtaccggctgttccgcaagagcaacctcaagcccttcgagcgggacatctccaccgagatctaccaggccgggagcaccccctgcaacggcgtcaaggggttcaactgctacttccccctgcagtcctacggcttccagccgacctacggggtgggctaccagccctaccgcgtggtcgtgctgagcttcgagctcctgcacgcccccgccacggtgtgcggccccaagaagtccaccaacctggtcaagaacaagtgcgtgaacttcaacttcaacgggctcaccggcaccggggtgctgaccgagagcaacaagaagttcctgccgttccagcagttcggccgggacatcgccgacacgaccgacgcggtccgcgacccccagaccctcgagatcctggacatcaccccctgcagcttcgggggcgtgtccgtgatcacgccgggcaccaacaccagcaaccaggtcgccgtgctgtaccagggggtgaactgcaccgaggtccccgtggccatccacgccgaccagctgacgcccacctggcgcgtgtactccaccggcagcaacgtcttccagacccgggccgggtgcctcatcggcgcggagcacgtgaacaactcctacgagtgcgacatccccatcggcgccgggatctgcgccagctaccagacgcagaccaactccccgcgccgggcccgcagcgtggcgtcccagagcatcatcgcctacaccatgtccctgggcgtcgagaacagcgtggcctactccaacaacagcatcgccatccccaccaacttcacgatctccgtgaccaccgagatcctgcccgtcagcatgaccaagacgagcgtggactgcaccatgtacatctgcggggactccaccgagtgcagcaacctcctgctgcagtacggctccttctgcacccagctcaaccgggccctgacggggatcgcggtggagcaggacaagaacacccaggaggtcttcgcccaggtgaagcagatctacaagacgcccccgatcaaggacttcggcggcttcaacttcagccagatcctgcccgacccctccaagcccagcaagcgctccttcatcgaggacctcctgttcaacaaggtgaccctggccgacgccgggttcatcaagcagtacggcgactgcctcggggacatcgccgcgcgggacctgatctgcgcccagaagttcaacggcctgaccgtcctcccgcccctgctgaccgacgagatgatcgcccagtacaccagcgccctcctggccgggaccatcacgtccggctggaccttcggcgcgggggccgccctgcagatccccttcgccatgcagatggcgtaccgcttcaacggcatcggggtgacccagaacgtgctctacgagaaccagaagctgatcgccaaccagttcaacagcgccatcggcaagatccaggactccctgagctccaccgccagcgccctcgggaagctgcaggacgtcgtgaaccagaacgcgcaggccctgaacacgctcgtgaagcagctgtccagcaacttcggcgccatctccagcgtcctgaacgacatcctctcccggctggacccgcccgaggccgaggtgcagatcgaccgcctgatcaccggccggctccagagcctgcagacctacgtgacccagcagctgatccgcgccgcggagatccgggccagcgccaacctcgccgccaccaagatgtccgagtgcgtcctggggcagagcaagcgcgtggacttctgcggcaaggggtaccacctgatgtccttcccccagagcgcgccccacggcgtggtcttcctccacgtgacgtacgtccccgcccaggagaagaacttcaccaccgccccggccatctgccacgacgggaaggcgcacttcccccgggagggcgtgttcgtgtccaacggcacccactggttcgtcacgcagcgcaacttctacgagccccagatcatcaccaccgacaacaccttcgtgagcgggaactgcgacgtggtcatcggcatcgtgaacaacacggtgtacgaccccctgcagccggagctggactccttcaaggaggagctcgacaagtacttcaagaaccacaccagccccgacgtcgacctgggggacatctccggcatcaacgccagcgtggtgaacatccagaaggagatcgaccggctgaacgaggtcgccaagaacctcaacgagtccctgatcgacctgcaggagctcggcaagtacgagcagtacatcaagtggccctggtacatctggctggggttcatcgccggcctgatcgccatcgtgatggtgaccatcatgctctgctgcatgaccagctgctgctcctgcctgaaggggtgctgcagctgcggctcctgctgcaagttcgacgaggacgacagcgagccggtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23770 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_K986P_V987P_E484K_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23771 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacttcaccaaccgcacccagctcccgagcgcctacacgaactccttcacccggggcgtctactaccccgacaaggtgttccgcagctccgtgctgcacagcacccaggacctgttcctccccttcttctccaacgtcacctggttccacgccatccacgtgagcgggacgaacggcaccaagcggttcgacaaccccgtgctgccgttcaacgacggggtctacttcgcgtccaccgagaagtccaacatcatccgcggctggatcttcgggaccacgctggactccaagacccagagcctcctgatcgtgaacaacgccaccaacgtggtcatcaaggtgtgcgagttccagttctgcaactaccccttcctgggcgtgtactaccacaagaacaacaagtcctggatggagagcgagttccgggtctactccagcgccaacaactgcaccttcgagtacgtgtcccagcccttcctcatggacctggagggcaagcaggggaacttcaagaacctgagcgagttcgtgttcaagaacatcgacggctacttcaagatctactccaagcacacgcccatcaacctcgtccgcgacctgccgcaggggttcagcgccctggagcccctcgtggacctgcccatcggcatcaacatcacccggttccagaccctgctcgccctgcaccgcagctacctgacccccggggactccagctccggctggacggcgggcgccgccgcctactacgtggggtacctccagccgcggaccttcctgctgaagtacaacgagaacggcaccatcaccgacgcggtcgactgcgccctcgaccccctgagcgagacgaagtgcaccctgaagtccttcaccgtggagaaggggatctaccagaccagcaacttccgcgtgcagcccacggagtccatcgtccggttccccaacatcaccaacctctgcccgttcggcgaggtgttcaacgccacccgcttcgccagcgtctacgcctggaaccggaagcgcatctccaactgcgtggcggactacagcgtgctgtacaactccgccagcttctccaccttcaagtgctacggcgtcagccccacgaagctgaacgacctctgcttcaccaacgtgtacgccgactccttcgtgatccgcggggacgaggtccggcagatcgcccccggccagaccgggaccatcgccgactacaactacaagctgcccgacgacttcacgggctgcgtgatcgcgtggaacagcaacaacctggactccaaggtcgggggcaactacaactacctctaccggctgttccgcaagagcaacctgaagccgttcgagcgggacatctccaccgagatctaccaggccggcagcaccccctgcaacggggtgaagggcttcaactgctacttccccctccagagctacgggttccagcccacctacggcgtggggtaccagccgtaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgcccttccagcagttcgggcgggacatcgccgacacgaccgacgcggtccgcgacccgcagaccctggagatcctggacatcaccccctgcagcttcggcggggtgtccgtgatcacgcccggcaccaacaccagcaaccaggtcgccgtgctctaccagggcgtgaactgcaccgaggtcccggtggccatccacgccgaccagctgacgcccacctggcgcgtgtactccaccgggagcaacgtcttccagacccgggccggctgcctgatcggggcggagtacgtgaacaactcctacgagtgcgacatccccatcggcgccggcatctgcgccagctaccagacgcagaccaacagcccccgccgggcccgcagcgtggcgtcccagagcatcatcgcctacaccatgtccctcggggccgagaacagcgtcgcctactccaacaacagcatcgccatcccgaccaacttcacgatcagcgtgaccaccgagatcctgcccgtgtccatgaccaagacgagcgtcgactgcaccatgtacatctgcggcgactccaccgagtgcagcaacctgctcctgcagtacgggtccttctgcacccagctgaaccgggcgctcacgggcatcgccgtggagcaggacaagaacacccaggaggtgttcgcccaggtcaagcagatctacaagaccccgcccatcaaggacttcgggggcttcaacttcagccagatcctgcccgacccctccaagcccagcaagcgctccttcatcgaggacctcctgttcaacaaggtgaccctggccgacgccggcttcatcaagcagtacggggactgcctgggcgacatcgcggcccgggacctcatctgcgcccagaagttcaacgggctgacggtgctgcccccgctcctgaccgacgagatgatcgcccagtacaccagcgccctgctcgcgggcaccatcacgtccgggtggaccttcggcgccggcgccgccctgcagatccccttcgcgatgcagatggcctaccgcttcaacgggatcggcgtcacccagaacgtgctgtacgagaaccagaagctcatcgccaaccagttcaacagcgccatcgggaagatccaggactccctgagctccaccgccagcgcgctgggcaagctccaggacgtggtcaaccagaacgcccaggccctgaacacgctggtgaagcagctctccagcaacttcggggccatctccagcgtgctgaacgacatcctgagccggctcgacccgcccgaggccgaggtccagatcgaccgcctgatcaccggccggctgcagtccctccagacctacgtgacccagcagctgatccgcgcggccgagatccgggccagcgccaacctggccgcgatcaagatgtccgagtgcgtgctcggccagagcaagcgcgtcgacttctgcgggaagggctaccacctgatgtccttcccccagagcgcgccccacggggtggtgttcctgcacgtcacctacgtgcccgcccaggagaagaacttcacgaccgcccccgccatctgccacgacggcaaggcccacttcccgcgggagggggtcttcgtgtccaacggcacccactggttcgtgacccagcgcaacttctacgagccccagatcatcacgaccgacaacaccttcgtcagcggcaactgcgacgtggtgatcgggatcgtcaacaacaccgtgtacgaccccctccagcccgagctggactccttcaaggaggagctggacaagtacttcaagaaccacacgagcccggacgtggacctcggcgacatctccgggatcaacgccagcgtcgtgaacatccagaaggagatcgaccggctgaacgaggtggccaagaacctgaacgagtccctcatcgacctgcaggagctgggcaagtacgagcagtacatcaagtggccctggtacatctggctcggcttcatcgccgggctgatcgcgatcgtcatggtgaccatcatgctgtgctgcatgaccagctgctgctcctgcctcaagggctgctgcagctgcgggtcctgctgcaagttcgacgaggacgacagcgagcccgtgctgaagggcgtcaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23772 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagcatccagtgcgtgaacctcaccacccgcacgcagctgccgcccgcctacaccaactccttcacccggggcgtctactaccccgacaaggtgttccgcagctccgtgctgcacagcacccaggacctcttcctgcccttcttctccaacgtcacgtggttccacgccatccacgtgagcgggaccaacggcaccaagcggttcgacaacccggtgctgcccttcaacgacggggtctacttcgcgtccaccgagaagtccaacatcatccgcggctggatcttcgggacgaccctcgacagcaagacccagagcctgctgatcgtgaacaacgccaccaacgtggtcatcaaggtgtgcgagttccagttctgcaacgaccccttcctcggcgtgtactaccacaagaacaacaagtcctgcatggagagcgagttccgggtctactccagcgccaacaactgcacgttcgagtacgtgtcccagcccttcctgatggacctggagggcaagcaggggaacttcaagaacctccgcgagttcgtgttcaagaacatcgacggctacttcaagatctacagcaagcacaccccgatcaacctggtccgggacctgccccaggggttctccgccctcgagcccctggtggacctgcccatcggcatcaacatcacccgcttccagaccctcctggccctgcaccggagctacctcacgccgggggactccagcagcggctggaccgcgggcgccgccgcctactacgtggggtacctgcagccccgcaccttcctgctcaagtacaacgagaacggcaccatcacggacgcggtcgactgcgccctggaccccctgtccgagaccaagtgcaccctcaagagcttcaccgtggagaaggggatctaccagacgtccaacttccgggtgcagcccaccgagagcatcgtccgcttcccgaacatcaccaacctgtgccccttcggcgaggtgttcaacgccacccggttcgcctccgtctacgcctggaaccgcaagcggatcagcaactgcgtggcggactactccgtgctgtacaacagcgcctccttcagcacgttcaagtgctacggcgtctcccccaccaagctcaacgacctgtgcttcaccaacgtgtacgccgacagcttcgtgatccgcggggacgaggtccggcagatcgcccccggccagaccgggaagatcgccgactacaactacaagctgccggacgacttcacgggctgcgtgatcgcgtggaactccaacaacctcgacagcaaggtcgggggcaactacaactaccgctaccggctgttccgcaagtccaacctgaagcccttcgagcgggacatcagcaccgagatctaccaggccggctccaccccctgcaacggggtggagggcttcaactgctacttccccctccagagctacgggttccagccgaccaacggcgtggggtaccagccctaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgccgttccagcagttcgggcgcgacatcgccgacacgaccgacgcggtccgggacccccagaccctggagatcctggacatcaccccctgcagcttcggcggggtgagcgtgatcacgccgggcaccaacacctccaaccaggtcgccgtgctctaccagggcgtgaactgcaccgaggtccccgtggccatccacgccgaccagctgacgcccacctggcgcgtgtacagcaccgggtccaacgtcttccagacccgggccggctgcctgatcggggcggagcacgtgaacaacagctacgagtgcgacatccccatcggcgccggcatctgcgcctcctaccagacgcagaccaacagcccgcgccgggcccgctccgtggcgagccagtccatcatcgcctacaccatgagcctcggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctgctcctgcagtacgggagcttctgcacccagctgaaccgggcgctcacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcgcagcttcatcgaggacctcctgttcaacaaggtgaccctggccgacgccggcttcatcaagcagtacggggactgcctgggcgacatcgcggcccgggacctcatctgcgcccagaagttcaacgggctgaccgtgctgccgcccctcctgaccgacgagatgatcgcccagtacacctccgccctgctcgcgggcaccatcacgagcgggtggaccttcggcgccggcgccgccctgcagatccccttcgcgatgcagatggcctaccgcttcaacgggatcggcgtcacccagaacgtgctgtacgagaaccagaagctcatcgccaaccagttcaactccgccatcgggaagatccaggacagcctgtccagcaccgcctccgcgctgggcaagctccaggacgtggtcaaccagaacgcccaggccctgaacacgctggtgaagcagctcagctccaacttcggggccatcagctccgtgctgaacgacatcctgagccggctcgacccgcccgaggccgaggtccagatcgaccgcctgatcaccggccggctgcagtccctccagacctacgtgacccagcagctgatccgcgcggccgagatccgggccagcgccaacctggccgcgaccaagatgagcgagtgcgtgctcggccagtccaagcgcgtcgacttctgcgggaagggctaccacctgatgagcttcccccagtccgcgccccacggggtggtgttcctgcacgtcacgtacgtgcccgcccaggagaagaacttcaccaccgccccggccatctgccacgacggcaaggcccacttcccccgggagggggtcttcgtgagcaacggcacccactggttcgtgacgcagcgcaacttctacgagccccagatcatcaccaccgacaacaccttcgtctccggcaactgcgacgtggtgatcgggatcgtcaacaacacggtgtacgaccccctccagccggagctggacagcttcaaggaggagctggacaagtacttcaagaaccacacctcccccgacgtggacctcggcgacatcagcgggatcaacgcctccgtcgtgaacatccagaaggagatcgaccggctgaacgaggtggccaagaacctgaacgagagcctcatcgacctgcaggagctgggcaagtacgagcagtacatcaagtggccctggtacatctggctcggcttcatcgccgggctgatcgcgatcgtcatggtgaccatcatgctgtgctgcatgacctcctgctgcagctgcctcaagggctgctgctcctgcgggagctgctgcaagttcgacgaggacgactccgagccggtgctgaagggcgtcaagctgcactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23773 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccaggacgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23774 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_ D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23775 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_A222V_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23776 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_N439K_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaagaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23777 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_S477N_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23778 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_N501Y_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23779 - RNA, 4185 nt, synthetic construct
  misc_feature 1..4185: note = SARS-CoV-2/Wuhan/WIV05/2019__EPI_ISL_402128 spike protein mRNA gc (1-1273)(K986P_V987P_H69del_V70del_D614G)
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23780 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_Y453F_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23781 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_D614G_I692V)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23782 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_D614G_M1229I)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23783 - RNA, 4185 nt, synthetic construct
  misc_feature 1..4185: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23784 - RNA, 4185 nt, synthetic construct
  misc_feature 1..4185: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23785 - RNA, 4182 nt, synthetic construct
  misc_feature 1..4182: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4182: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgacgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcacaccggagggcaaggagcgtggccagccagagcatcatcgcctacaccatgagcctgggcgccgagaacagcgtggcctacagcaacaacagcatcgccatccccatcaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctggcccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23786 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23787 - RNA, 4182 nt, synthetic construct
  misc_feature 1..4182: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4182: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacttcaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgccaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcggggcctgccccagggcttctcagccctggagcccctggtggacctgcccatcggcatcaacatcacccggttccagaccctgcacatcagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgtggagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23788 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_K986P_V987P_E484K_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23789 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacttcaccaaccggacccagctgccaagcgcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaactaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgagcgagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaccatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagtacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccatcaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23790 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcatccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctgcatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactaccgctaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23791 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccaggacgtgaactgcaccgaggtgcccgtggccatccacgccgaccagctgacccccacctggcgggtgtacagcaccggaagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgattgcctgggcgacatcgccgctcgggacctgatctgcgcccagaagttcaacgggctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggcgtgttcgtgagcaacggaacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23792 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_ D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23793 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_A222V_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtcagcgtgatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagcccccggcgggcccggagcgtggccagccagagcatcatcgcctacaccatgagcttaggcgccgagaacagcgtggcctacagcaacaacagcatcgccatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttttgcggcaagggctaccacctgatgagcttcccccagagcgctccccacggcgtggtgttcctccacgtcacatacgtgcccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23794 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_N439K_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaagaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggatcccccagaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23795 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_S477N_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcaacaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgcgcctcctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaatttcggcgccatcagcagcgtgctgaacgacatcctgtcaaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23796 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_N501Y_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggatcccccagaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23797 - RNA, 4185 nt, synthetic construct
  misc_feature 1..4185: note = SARS-CoV-2/Wuhan/WIV05/2019__EPI_ISL_402128 spike protein mRNA gc (1-1273)(K986P_V987P_H69del_V70del_D614G)
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtgcccgcccaggagaagaacttcaccaccgcccccgccatttgccacgacggcaaggcccacttcccccgggagggagtcttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23798 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_Y453F_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23799 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_D614G_I692V)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtcacatacgtgcccgcccaggagaagaacttcaccaccgcccccgccatctgccacgacggcaaggcccacttcccccgggagggagtgttcgtgagcaacggcacccactggttcgtgacccagcggaacttctacgagcctcagattatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23800 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_D614G_M1229I)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23801 - RNA, 4185 nt, synthetic construct
  misc_feature 1..4185: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcaacaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtgagcgtcatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgccggcatctgcgcttcctaccagacccagaccaacagcccccggcgggcccggagcgtggccagccagagcgtgatcgcctacaccatgagcttaggcgccgagaacagcgtggcctacagcaacaacagcatcgccatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaattttggcgccatcagcagcgtgctgaacgacatcctgtcaaggctggatcccccagaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttctgcggcaagggctaccacctgatgagcttcccccagagcgctccccacggcgtggtgttcctccacgtcacatacgtgcccgcccaggagaagaacttcaccaccgcccccgccatctgccacgacggcaaggcccacttcccccgggagggagtgttcgtgagcaacggcacccactggttcgtgacccagcggaacttctacgagcctcagattatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23802 - RNA, 4185 nt, synthetic construct
  misc_feature 1..4185: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgctccccacggcgtggtgttcctccacgtgacatacgtccccgcccaggagaagaacttcaccaccgcccccgccatctgccacgacggcaaggcccacttcccccgggagggagtgttcgtgagcaacggcacccactggttcgtgacccagcggaacttctacgagcctcagattatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23803 - RNA, 4182 nt, synthetic construct
  misc_feature 1..4182: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4182: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgacgacaccaccgacgccgtgcgggacccccagaccctggagatcctggacatcaccccatgcagcttcggcggcgtgagcgtgatcacccccggcacaaacaccagcaaccaggtcgcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagccaccggcgggcccggagcgtggccagccagagcatcatcgcctacaccatgagcttaggcgccgagaacagcgtggcctacagcaacaacagcatcgccatccccatcaacttcaccataagcgtgaccaccgagatcctgcctgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagaccccacccatcaaggacttcggcggcttcaacttcagccagatcctgcccgaccccagcaagcccagcaagcggagcttcatcgaggacctgctgttcaacaaggtgactctggccgacgccggcttcatcaagcagtacggcgattgcctgggggacatcgccgcccgggacctgatctgcgctcagaagttcaacggcctgaccgtgctgcctcccctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaacgacatcctggccaggctggacccacccgaggccgaggtgcagatcgaccggctgatcaccggccggctgcagagcctgcagacctacgtgacccagcagctgatccgggccgccgagattcgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacctacgtgcccgcccaggagaagaacttcacaaccgcccccgccatctgccacgacggcaaggcccacttcccccgggagggagtcttcgtgagcaacggcacccactggttcgtgacccagcggaacttctacgagccccagatcatcaccacccacaacaccttcgtgagcggcaactgcgacgtggtgatcggcatcgtgaacaacaccgtgtacgaccctctgcagcccgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccatggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23804 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23805 - RNA, 4182 nt, synthetic construct
  misc_feature 1..4182: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4182: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacttcaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgccaacccagtgctgcccttcaacgacggcgtgtacttcgccagcaccgagaagtcaaacatcatccggggctggatctttggcaccaccctggacagcaagacacagagcctgctgatcgtgaacaacgctaccaacgtggtgatcaaggtgtgcgagttccagttctgcaacgaccccttcctgggcgtgtactaccacaagaacaacaagagctggatggagagcgagttccgggtctacagcagcgccaacaattgcaccttcgagtacgtgagccagcccttcctgatggacctggagggcaagcagggcaacttcaagaacctccgggagttcgtgttcaagaacatcgacggctacttcaagatctacagcaagcacacccccatcaacctggtgcggggactgccccagggcttcagcgccctggagcctctggtggatctgcccatcggcatcaacatcaccaggttccagaccctgcacatcagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcacccttaagagcttcaccgtggagaagggcatctaccagaccagcaacttccgggtgcagcccactgagagcattgtgcggttccccaacatcaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctattccgtaagagcaacctgaagccatttgagcgggacatcagcaccgagatctaccaggccggtagcaccccctgcaacggcgtgaagggcttcaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggacatcgccgacaccaccgatgcagtgcgggacccccagaccctggagatcctggacatcaccccatgcagcttcggcggcgtgagcgtcatcacccccggaacaaacaccagcaaccaggtggccgtgctgtaccagggcgtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcctgggcgtggagaacagcgtggcctacagcaacaacagcatcgccatccctaccaacttcaccataagcgtgaccaccgagatcctgcccgtgagcatgaccaagaccagcgtggactgtaccatgtacatctgcggcgacagcaccgagtgcagcaacctgttactgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggggactgcctgggcgacatcgccgcccgggacctgatctgcgctcagaagttcaacggcctgaccgtgctgccccctctgctgaccgatgagatgatcgcccagtacaccagcgccctgctggccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaactttggcgccatcagctcagtgctgaatgacatcctgagccggctggatcccccagaggccgaggtgcagatcgacaggctgatcaccggccggctgcagagcctgcagacctacgtgacccagcagctgatccgggccgccgagattcgggccagcgccaacctggccgcaaccaagatgagcgagtgcgtgctgggccagagcaagcgggtggacttctgcggcaagggctaccacctgatgagcttcccccagagcgctccccacggcgtggtgttcctgcacgtcacatacgtgcccgcccaggagaagaacttcaccaccgcccccgccatctgccacgacggaaaggcccacttcccccgggagggcgtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctcgacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23806 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_K986P_V987P_E484K_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23807 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacttcaccaaccggacccagctgcccagcgcctacaccaacagcttcacccggggcgtgtactaccctgacaaggtgttccggagcagcgtgctgcacagcacccaggacctgttcctgcccttcttcagcaacgtgacctggttccacgccatccacgtgagcggcaccaacggcaccaagcggttcgacaaccccgtgctgccattcaacgacggcgtgtacttcgccagcaccgagaagtcaaacatcatccggggctggatctttggcaccaccctggacagcaagacccagagcctgctgatcgtgaacaacgccacaaacgtggtgatcaaggtgtgcgagttccagttctgcaactaccccttcctgggcgtgtactaccacaagaacaacaagagctggatggagagcgagttccgggtctacagcagcgctaataactgcaccttcgagtacgtgagccagcccttcctgatggacctggagggcaagcagggcaacttcaagaacctcagcgagttcgtgttcaagaacatcgacggctacttcaagatctacagcaagcacacccccatcaacctggtgcgggatctgccccagggattcagcgccctggagcccctggtggacctgcctatcggcatcaacatcacccggttccagaccctgctggccctgcacaggagctacctgacccccggcgacagcagcagcggctggaccgccggcgccgccgcatactacgtgggctacctgcagccccggaccttcctgctgaagtacaacgagaacggcaccatcaccgacgccgtggactgcgccctggacccactgagcgagaccaagtgcaccctaaagagcttcaccgtggagaagggcatctaccagaccagcaacttccgggtgcagcccaccgagagcatcgtgcggttccccaacattactaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgctgacagcttcgtgatccggggcgacgaggtgcggcagatcgcccctggccagaccggcaccatcgccgactacaactacaagctgcccgacgacttcaccggctgcgtgatcgcctggaacagcaacaacctggacagcaaggtgggcggcaactacaactacctgtaccggctgttccgtaagagcaacctgaagccctttgagcgggacatcagcaccgagatctaccaggccggcagcaccccatgcaacggtgtgaagggcttcaactgctacttccccctgcagagctacggcttccagcccacctacggcgtgggctaccagccctaccgggtggtggtgctgagcttcgagctgctgcacgcccccgccaccgtgtgcggccccaaaaagagcaccaacctggtgaagaacaagtgcgtgaacttcaatttcaacggcctgaccggcaccggcgtgctgaccgagagcaacaagaagttcctgcctttccagcagttcggccgggacatcgccgataccaccgacgcagtgcgggacccccagaccctggagatcctggacatcaccccctgcagcttcggcggcgtgagcgtcatcaccccaggcacaaacaccagcaaccaggtggccgtgctgtaccagggagtgaactgcaccgaggtgcccgtggccatccacgccgaccagctgacccccacctggcgggtgtactccaccggcagcaacgtgttccagacccgggccggctgcctgatcggcgccgagtacgtgaacaacagctacgagtgcgacatccccatcggcgctggcatctgcgccagctaccagacccagaccaacagcccccggcgggcccggagcgtggccagccagagcatcatcgcctacaccatgagcctgggcgccgagaacagcgtggcctacagcaacaacagcatcgcgatccccaccaacttcaccatcagcgtgaccaccgagatattacctgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactccacccatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggacatcgccgctcgggatctgatctgcgcccagaagttcaacggcctgaccgtgctgcctcccctgctgaccgacgagatgatcgcccagtacaccagcgccctgctggccggcaccatcaccagcggctggaccttcggcgccggcgcagcccttcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagctcaaactttggcgccatcagcagcgtgctgaatgacatcctgagccggctggacccacccgaggccgaggtgcagatcgacaggctgatcaccggccggctgcagagcctgcagacctacgtgacccagcagctgatccgggccgccgagatccgggccagcgccaacctggcagccattaagatgagcgagtgcgtgctgggccagagcaagcgggtggacttctgcggcaagggctaccacctgatgagcttcccccagagcgctccccacggcgtggtgttcctgcacgtgacctacgtccccgcccaggagaagaacttcacaaccgcccccgccatctgccacgacggcaaggcccacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccctctccagcccgagctggacagcttcaaggaggagctggacaagtacttcaagaaccacaccagccccgacgtggacctgggcgatatcagcggcatcaacgccagcgtggtgaacatccagaaggagatcgaccggctgaacgaggtggccaagaacctgaacgagagcctgatcgacctgcaggagctgggcaagtacgagcagtacatcaagtggccatggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23808 - RNA, 4191 nt, synthetic construct
  misc_feature 1..4191: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcatccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctgcatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgtaccctaaagagcttcaccgtggagaagggcatctaccagaccagcaacttccgggtgcagcccactgagagcattgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactaccggtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgtgcctcctaccagacccagaccaacagcccccggcgggcccggagcgtggccagccagagcatcatcgcctacaccatgagcctgggcgccgagaacagcgtggcctacagcaacaacagcatcgcgatccctaccaacttcaccataagcgtgaccaccgagatcttacccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgctggccggcaccatcaccagcggctggaccttcggcgccggcgcagcccttcagatccccttcgccatgcagatggcctacaggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagcagcgtgctgaatgacatcctgtcacggctggatcccccagaggccgaggtgcagatcgaccggctgatcaccggccggctgcagagcctgcagacctacgtgacccagcagctgatccgggccgccgagattcgggccagcgccaacctggcagccaccaagatgagcgagtgcgtgctgggccagagcaagcgggtggacttttgcggcaagggctaccacctgatgagcttcccccagagcgctccccacggcgtggtgttcctgcacgtgacatacgtccccgcccaggagaagaacttcaccaccgcccccgccatctgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctccagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgttgcagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23809 - RNA, 4191 nt, synthetic construct
  misc_feature 1..4191: note = SARS-CoV-2/Wuhan/WIV05/2019__EPI_ISL_402128 spike protein mRNA gc mod (1-1273)(K986P_V987P)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23810 - RNA, 4191 nt, synthetic construct
  misc_feature 1..4191: note = SARS-CoV-2/Wuhan/WIV05/2019__EPI_ISL_402128 spike protein mRNA gc mod (1-1273)(K986P_V987P_ D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23811 - RNA, 4191 nt, synthetic construct
  misc_feature 1..4191: note = SARS-CoV-2/Wuhan/WIV05/2019__EPI_ISL_402128 spike protein mRNA gc mod (1-1273)(K986P_V987P_A222V_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23812 - RNA, 4191 nt, synthetic construct
  misc_feature 1..4191: note = SARS-CoV-2/Wuhan/WIV05/2019__EPI_ISL_402128 spike protein mRNA gc mod (1-1273)(K986P_V987P_N439K_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23813 - RNA, 4191 nt, synthetic construct
  misc_feature 1..4191: note = SARS-CoV-2/Wuhan/WIV05/2019__EPI_ISL_402128 spike protein mRNA gc mod (1-1273)(K986P_V987P_S477N_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23814 - RNA, 4191 nt, synthetic construct
  misc_feature 1..4191: note = SARS-CoV-2/Wuhan/WIV05/2019__EPI_ISL_402128 spike protein mRNA gc mod (1-1273)(K986P_V987P_N501Y_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23815 - RNA, 4185 nt, synthetic construct
  misc_feature 1..4185: note = SARS-CoV-2/Wuhan/WIV05/2019__EPI_ISL_402128 spike protein mRNA gc mod (1-1273)(K986P_V987P_H69del_V70del_D614G)
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23816 - RNA, 4191 nt, synthetic construct
  misc_feature 1..4191: note = SARS-CoV-2/Wuhan/WIV05/2019__EPI_ISL_402128 spike protein mRNA gc mod (1-1273)(K986P_V987P_Y453F_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23817 - RNA, 4191 nt, synthetic construct
  misc_feature 1..4191: note = SARS-CoV-2/Wuhan/WIV05/2019__EPI_ISL_402128 spike protein mRNA gc mod (1-1273)(K986P_V987P_D614G_I692V)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23818 - RNA, 4191 nt, synthetic construct
  misc_feature 1..4191: note = SARS-CoV-2/Wuhan/WIV05/2019__EPI_ISL_402128 spike protein mRNA gc mod (1-1273)(K986P_V987P_D614G_M1229I)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23819 - RNA, 4185 nt, synthetic construct
  misc_feature 1..4185: note = SARS-CoV-2/Wuhan/WIV05/2019__EPI_ISL_402128 spike protein mRNA gc mod (1-1273)(K986P_V987P_H69del_V70del_A222V_Y453F_S477N_D614G_ I692V)
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23820 - RNA, 4185 nt, synthetic construct
  misc_feature 1..4185: note = SARS-CoV-2/Wuhan/WIV05/2019__EPI_ISL_402128 spike protein mRNA gc mod (1-1273)(K986P_V987P_H69del_V70del_Y453F_D614G_I692V_M1229I )
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23821 - RNA, 4182 nt, synthetic construct
  misc_feature 1..4182: note = SARS-CoV-2/Wuhan/WIV05/2019__EPI_ISL_402128 spike protein mRNA gc mod (1-1273)(K986P_V987P_K986P_V987P_H69del_V70del_Y144del_N501 Y_A570D_D614G_P681H_T716I_S982A_D1118H)
  source 1..4182: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccacagacgggctagaagcgtggccagccagagcatcattgcctacacaatgtctctgggcgccgagaacagcgtggcctactccaacaactctatcgctatccccatcaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23822 - RNA, 4191 nt, synthetic construct
  misc_feature 1..4191: note = SARS-CoV-2/Wuhan/WIV05/2019__EPI_ISL_402128 spike protein mRNA gc mod (1-1273)(K986P_V987P_K986P_V987P_K417N_E484K_N501Y_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23823 - RNA, 4182 nt, synthetic construct
  misc_feature 1..4182: note = SARS-CoV-2/Wuhan/WIV05/2019__EPI_ISL_402128 spike protein mRNA gc mod (1-1273)(K986P_V987P_K986P_V987P_L18F_D80A_D215G_L242del_A2 43del_L244del_R246I_K417N_E484K_N501Y_D614G_A701V)
  source 1..4182: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacttcaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgtggagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23824 - RNA, 4191 nt, synthetic construct
  misc_feature 1..4191: note = SARS-CoV-2/Wuhan/WIV05/2019__EPI_ISL_402128 spike protein mRNA gc mod (1-1273)(K986P_V987P_K986P_V987P_E484K_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23825 - RNA, 4191 nt, synthetic construct
  misc_feature 1..4191: note = SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S _K417T_E484K_N501Y_D614G_H655Y_T1027I)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacttcaccaacagaacacagctgcctagcgcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23826 - RNA, 4191 nt, synthetic construct
  misc_feature 1..4191: note = SARS-CoV-2/Wuhan/WIV05/2019__EPI_ISL_402128 spike protein mRNA gc mod (1-1273)(K986P_V987P_K986P_V987P_S13I_W152C_L452R_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccatccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23827 - RNA, 4191 nt, synthetic construct
  misc_feature 1..4191: note = SARS-CoV-2/Wuhan/WIV05/2019__EPI_ISL_402128 spike protein mRNA gc mod (1-1273)(K986P_V987P)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23828 - RNA, 4191 nt, synthetic construct
  misc_feature 1..4191: note = SARS-CoV-2/Wuhan/WIV05/2019__EPI_ISL_402128 spike protein mRNA gc mod (1-1273)(K986P_V987P_ D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23829 - RNA, 4191 nt, synthetic construct
  misc_feature 1..4191: note = SARS-CoV-2/Wuhan/WIV05/2019__EPI_ISL_402128 spike protein mRNA gc mod (1-1273)(K986P_V987P_A222V_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23830 - RNA, 4191 nt, synthetic construct
  misc_feature 1..4191: note = SARS-CoV-2/Wuhan/WIV05/2019__EPI_ISL_402128 spike protein mRNA gc mod (1-1273)(K986P_V987P_N439K_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23831 - RNA, 4191 nt, synthetic construct
  misc_feature 1..4191: note = SARS-CoV-2/Wuhan/WIV05/2019__EPI_ISL_402128 spike protein mRNA gc mod (1-1273)(K986P_V987P_S477N_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23832 - RNA, 4191 nt, synthetic construct
  misc_feature 1..4191: note = SARS-CoV-2/Wuhan/WIV05/2019__EPI_ISL_402128 spike protein mRNA gc mod (1-1273)(K986P_V987P_N501Y_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23833 - RNA, 4185 nt, synthetic construct
  misc_feature 1..4185: note = SARS-CoV-2/Wuhan/WIV05/2019__EPI_ISL_402128 spike protein mRNA gc mod (1-1273)(K986P_V987P_H69del_V70del_D614G)
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa
